(12) United States Patent
Ariyama et al.

(10) Patent No.: US 11,466,272 B2
(45) Date of Patent: Oct. 11, 2022

(54) NUCLEIC ACID SUPPRESSING EXPRESSION OF APCS

(71) Applicant: KYOWA KIRIN CO., LTD., Tokyo (JP)

(72) Inventors: Hiroyuki Ariyama, Tokyo (JP); Takuya Murakami, Tokyo (JP); Takashi Imaeda, Tokyo (JP); Tatsuya Miyazawa, Tokyo (JP)

(73) Assignee: KYOWA KIRIN CO., LTD., Tokyo (JP)

( * ) Notice: Subject to any disclaimer, the term of this patent is extended or adjusted under 35 U.S.C. 154(b) by 52 days.

(21) Appl. No.: 16/617,743

(22) PCT Filed: May 31, 2018

(86) PCT No.: PCT/JP2018/020941
§ 371 (c)(1),
(2) Date: Nov. 27, 2019

(87) PCT Pub. No.: WO2018/221649
PCT Pub. Date: Dec. 6, 2018

(65) Prior Publication Data
US 2020/0190514 A1    Jun. 18, 2020

(30) Foreign Application Priority Data
May 31, 2017  (JP) ................ JP2017-108502

(51) Int. Cl.
*C12N 15/113*        (2010.01)
(52) U.S. Cl.
CPC ........ *C12N 15/113* (2013.01); *C12N 2310/11* (2013.01)
(58) Field of Classification Search
CPC .............. C12N 15/113; C12N 2310/14; C12N 2310/321; A61K 31/713; A61K 48/00; A61P 3/00
See application file for complete search history.

(56) References Cited

U.S. PATENT DOCUMENTS

| | | | |
|---|---|---|---|
| 6,126,918 A * | 10/2000 | Pepys ................... | A61K 49/14 424/9.1 |
| 6,291,668 B1 | 9/2001 | Ziegler et al. | |
| 8,394,628 B2 | 3/2013 | Tuschl et al. | |
| 8,420,391 B2 | 4/2013 | Tuschl et al. | |
| 8,552,171 B2 | 10/2013 | Tuschl et al. | |
| 8,632,997 B2 | 1/2014 | Tuschl et al. | |
| 8,742,092 B2 | 6/2014 | Tuschl et al. | |
| 8,790,922 B2 | 7/2014 | Tuschl et al. | |
| 9,012,138 B2 | 4/2015 | Tuschl et al. | |
| 9,012,621 B2 | 4/2015 | Tuschl et al. | |
| 9,193,753 B2 | 11/2015 | Tuschl et al. | |
| 10,472,625 B2 | 11/2019 | Tuschl et al. | |
| 2002/0086356 A1 | 7/2002 | Tuschl et al. | |
| 2003/0108923 A1 | 6/2003 | Tuschl et al. | |
| 2007/0003960 A1 | 1/2007 | Tuschl et al. | |
| 2007/0003961 A1 | 1/2007 | Tuschl et al. | |
| 2007/0003962 A1 | 1/2007 | Tuschl et al. | |
| 2007/0003963 A1 | 1/2007 | Tuschl et al. | |
| 2008/0113351 A1 | 5/2008 | Naito et al. | |
| 2008/0132461 A1 | 6/2008 | Tuschi et al. | |
| 2009/0186843 A1 | 7/2009 | Tuschl et al. | |
| 2011/0054005 A1 | 3/2011 | Naito et al. | |
| 2011/0150897 A1 | 6/2011 | Meyer et al. | |
| 2011/0244446 A1 | 10/2011 | Tuschl et al. | |
| 2011/0244568 A1 | 10/2011 | Tuschl et al. | |
| 2011/0245318 A1 | 10/2011 | Tuschl et al. | |
| 2011/0281931 A1 | 11/2011 | Tuschl et al. | |
| 2011/0289611 A1 | 11/2011 | Tuschl et al. | |
| 2012/0015042 A1 | 1/2012 | Tuschl et al. | |
| 2012/0029061 A1 | 2/2012 | Tuschl et al. | |
| 2012/0052487 A9 * | 3/2012 | Khvorova ................ | A61P 3/10 435/6.1 |
| 2012/0122111 A1 | 5/2012 | Tuschl et al. | |
| 2013/0198875 A1 | 8/2013 | Tuschl et al. | |
| 2016/0032288 A1 | 2/2016 | Tuschl et al. | |
| 2020/0270602 A1 | 8/2020 | Tuschl et al. | |

FOREIGN PATENT DOCUMENTS

| | | |
|---|---|---|
| WO | 98/56905 | 12/1998 |
| WO | 01/75164 | 10/2001 |
| WO | 2005/116204 | 12/2005 |

(Continued)

OTHER PUBLICATIONS

Jackson et al (Nature Biotech. 21(6):636-637, 2002) (Year: 2002).*
Allerson et al (J. Med. Chem. 2005, 48, 901-904) (Year: 2005).*
International Search Report dated Jul. 17, 2018 in International (PCT) Application No. PCT/JP2018/020941 with English-language translation.
Pepys et al., "Amyloid P component. A critical review", The Journal of Protein Folding Disorders, 1997, vol. 4, pp. 274-295.
Hawkins et al., "Evaluation of Systemic Amyloidosis by Scintigraphy With [123]I-Labeled Serum Amyloid P Component", The New England Journal of Medicine, 1990, vol. 323, pp. 508-513.
Bodin et al., "Antibodies to human serum amyloid P component eliminate visceral amyloid deposits", Nature, 2010, vol. 468, pp. 93-97.
Richards et al., "Therapeutic Clearance of Amyloid by Antibodies to Serum Amyloid P Component", The New England Journal of Medicine, 2015, vol. 373, pp. 1106-1114.

(Continued)

*Primary Examiner* — Richard A Schnizer
(74) *Attorney, Agent, or Firm* — Wenderoth, Lind & Ponack, L.L.P.

(57) ABSTRACT

The present invention provides a double-stranded nucleic acid consisting of a sense-strand nucleic acid and an antisense-strand nucleic acid and comprising a double-strand region having at least 11 base pairs, for suppressing expression of APCS gene, in which an oligonucleotide chain having a chain length of at least 17 nucleotides and at most 30 nucleotides in the antisense-strand nucleic acid is complementary to a target APCS mRNA sequence comprising a base sequence set forth in any one of SEQ ID NOS: 1288 to 1930.

14 Claims, No Drawings
Specification includes a Sequence Listing.

(56) References Cited

FOREIGN PATENT DOCUMENTS

WO         2008/043561       4/2008
WO         WO-2019100039 A1 *    5/2019            A61K 31/713

OTHER PUBLICATIONS

Muczynski et al., "Complex formation with pentraxin-2 regulates factor X plasma levels and macrophage interactions", The American Society of Hematology, 2017, vol. 129, No. 17, pp. 2443-2454.
Botto et al., "Amyloid deposition is delayed in mice with targeted deletion of the serum amyloid P component gene", Nature Medicine, 1997, vol. 3, No. 8, pp. 885-859.
Mantzouranis et al., "Human Serum Amyloid P Component", The Journal of Biological Chemistiy, 1985, vol. 260, No. 12, pp. 7752-7756.
Pepys et al., "Targeted pharmacological depletion of serum amyloid P component for treatment of human amyloidosis", Nature, 2002, vol. 417, No. 6886, pp. 254-259.

* cited by examiner

… … …

NUCLEIC ACID SUPPRESSING EXPRESSION OF APCS

TECHNICAL FIELD

The present invention relates to a nucleic acid that suppresses expression of APCS or a pharmaceutical composition comprising the nucleic acid.

BACKGROUND ART

APCS (amyloid P component, serum; also referred to as Serum amyloid P, SAP or Pentraxin-2) has a pentamer structure of a glycoprotein constituted of 223 amino acids. APCS is a protein produced in the liver and present in the blood at a relatively high concentration of 30 to 50 µg/mL.

APCS has a biochemical property of binding to all types of amyloid fibrils in a calcium-dependent manner. It is known that APCS is contained in an amount as large as 20,000 mg in amyloid of patients having amyloid (non-Patent Literature 1).

Since APCS is present in amyloid of all patients with an amyloid-related disease, APCS is used as a diagnostic marker in patients with an amyloid-related disease (non-Patent Literature 2).

The amyloid-related disease is a disease causing organ damage, which is caused by accumulation of abnormal insoluble protein-fibers (known as amyloid fibrils) on a tissue.

It has been clarified that amyloid to which APCS binds can be stabilized by APCS inducing resistance to decomposition with protease and phagocytosis by immune cells. Also, researches and clinical studies using animal models strongly suggest that amyloid accumulation on organs and tissue disorders associated to the accumulation can be reduced by inhibiting binding of APCS to amyloid (non-Patent Literatures 3, 4). It is expected that amyloid-related diseases can be prevented or treated by specifically suppressing expression of APCS; however, pharmaceutical products that specifically suppresses expression of APCS have not yet been reported up to present.

As a method for suppressing expression of a gene, itself, for example, a method of using RNA interference (also referred to as RNAi) is known. More specifically, it has been found that expression of a target gene is specifically suppressed by introduction of double strand RNA having the same sequence as a target gene, and the RNA is called as short interfering RNA (siRNA) (Patent Literature 1). Alternatively, as a method for suppressing expression of a gene other than RNA interference, an antisense method is known (Patent Literature 2).

A part of the siRNA sequence targeting human APCS mRNA is disclosed; however, it has not been known that the siRNA sequence suppresses expression of human APCS (Patent Literatures 3, 4).

CITATION LIST

Patent Literatures

Patent Literature 1: International Publication No. WO2001/75164
Patent Literature 2: International Publication No. WO98/56905
Patent Literature 3: International Publication No. WO2005/116204
Patent Literature 4: International Publication No. WO2008/043561

Non Patent Literature 1: Amyloid, 4: 4, 274-295 (1997)
Non Patent Literature 2: N. Engl. J. Med. 1990; 323: 508-13
Non Patent Literature 3: Nature 468: 93-97. (2010)
Non Patent Literature 4: N. Engl. J. Med. 373: 1106-14. (2015)

SUMMARY OF INVENTION

Technical Problem

An object of the present invention is to provide a nucleic acid capable of suppressing the expression of APCS.

Solution to Problem

The present invention relates to the following (1) to (13).

(1) A double-stranded nucleic acid consisting of a sense-strand nucleic acid and an antisense-strand nucleic acid and comprising a double-strand region having at least 11 base pairs, for suppressing expression of APCS gene, wherein an oligonucleotide chain having a chain length of at least 17 nucleotides and at most 30 nucleotides in the antisense-strand nucleic acid is complementary to a target APCS mRNA sequence comprising a base sequence set forth in any one of SEQ ID NOS: 1288 to 1930.

(2) The double-stranded nucleic acid according to (1), wherein the double-strand region has 11 to 27 base pairs and a nucleotide at position 2 counted from a 5' end of the antisense-strand nucleic acid is complementary to a nucleotide at position 2 counted from a 3' end of the target APCS mRNA sequence.

(3) The double-stranded nucleic acid according to (1) or (2), wherein a 3' end of the sense-strand nucleic acid and a 5' end of the antisense-strand nucleic acid and/or the 5' end of the sense-strand nucleic acid and the 3' end of the antisense-strand nucleic acid form a blunt end.

(4) The double-stranded nucleic acid according to any one of (1) to (3), wherein the sense-strand nucleic acid has a chain length of 21 nucleotides and the antisense-strand nucleic acid has a chain length of 21 nucleotides.

(5) The double-stranded nucleic acid according to (4), comprising a double-strand region having 19 base pairs, in which 40 to 65% of the nucleotides in the double-strand region are 2'-O-methyl modified nucleotides.

(6) The double-stranded nucleic acid according to any one of (1) to (5), wherein the antisense-strand nucleic acid comprises a base sequence set forth in any one of SEQ ID NOS: 645 to 1287 and 1975 to 2018.

(7) The double-stranded nucleic acid according to any one of (1) to (6), wherein the sense-strand nucleic acid comprises a base sequence set forth in any one of SEQ ID NOS: 2 to 644 and 1931 to 1974.

(8) The double-stranded nucleic acid according to any one of (1) to (7), wherein the sense-strand nucleic acid comprises a base sequence set forth in any one of SEQ ID NOS: 2 to 644 and 1931 to 1974, and correspondingly thereto, the antisense-strand nucleic acid comprises a base sequence set forth in any one of SEQ ID NOS: 645 to 1287 and 1975 to 2018.

(9) The double-stranded nucleic acid according to any one of (1) to (8), comprising a ligand.

(10) A single-stranded nucleic acid consisting of only the antisense-strand nucleic acid of the double-stranded nucleic acid according to any one of (1) to (9).

(11) A pharmaceutical composition comprising the nucleic acid according to any one of (1) to (10).

(12) A method for treating a disorder mediated by APCS-containing amyloid fibrils, comprising a step of administering a therapeutically effective amount of the nucleic acid according to any one of (1) to (10) or the pharmaceutical composition according to (11) to a human in need of such a treatment.

(13) The method according to (12), wherein the disorder is an amyloid-related disease.

Advantageous Effects of Invention

According to the present invention, it is possible to provide a nucleic acid capable of suppressing the expression of APCS.

DESCRIPTION OF EMBODIMENTS

A target of the nucleic acid of the present invention, APCS mRNA, is homologous to the sequence of SEQ ID NO: 1 registered in the Genbank under Accession No. NM_001639.3 and full-length mRNA of APCS having a base sequence, in which T of the sequence of SEQ ID NO: 1 is replaced by U. Herein, the complementary DNA of mRNA is defined as 1st strand cDNA, and a DNA, which is to be synthesized based on the 1st strand cDNA in order to obtain a double strand, is defined as the 2nd strand cDNA. In this case, SEQ ID NO: 1 represents the base sequence of the 2nd strand cDNA of APCS. Note that the base sequence of APCS mRNA and the base sequence of the 2nd strand cDNA of APCS are homologous.

1. Nucleic Acid of the Present Invention

In the present invention, a nucleic acid comprising the base sequence complementary to the APCS mRNA sequence is referred to as an antisense-strand nucleic acid; whereas a nucleic acid comprising the base sequence complementary to the base sequence of the antisense-strand nucleic acid is referred to as a sense-strand nucleic acid. As used herein, "the nucleic acid of the present invention", until otherwise specified, means nucleic acids including a single-stranded nucleic acid that is an antisense-strand nucleic acid or a sense-strand nucleic acid, and a double-stranded nucleic acid formed by pairing of the antisense-strand nucleic acid and the sense-strand nucleic acid.

The nucleic acid of the present invention may be any molecule as long as the molecule is a polymer of a nucleotide or a polymer of a molecule having the same function as a nucleotide. Examples of the nucleic acid include a ribonucleotide polymer, i.e., RNA; a deoxyribonucleotide polymer, i.e., DNA; a polymer of a ribonucleotide and deoxyribonucleotide, i.e., a chimeric nucleic acid; and a nucleotide polymer prepared by replacing at least one nucleotide of these nucleic acids (RNA, DNA, and chimeric nucleic acid) by a molecule having the same function as the nucleotide. Uracil (U) in RNA is univocally replaced by thymine (T) in DNA.

An example of the molecule having the same function as a nucleotide is a nucleotide derivative obtained by modifying a nucleotide.

Although it is not particularly limited, use of a nucleotide derivative has the advantages: for example, resistance against nuclease can be improved or stabilized compared to RNA or DNA; affinity for a complementary strand nucleic acid can be improved; cell permeability can be improved; and/or visualization can be made.

Examples of the nucleotide derivative include a nucleotide modified in the sugar portion, a nucleotide modified in a phosphate-diester bond, a nucleotide modified in a base and a nucleotide modified in two or more elements of a sugar portion, a phosphate diester bond and a base.

As the nucleotide modified in the sugar portion, any nucleotide may be used as long as part or whole of the chemical structure of the nucleotide sugar is modified or substituted with a substituent, or substituted with an atom; however, a 2'-modified nucleotide is preferably used.

Examples of the 2'-modified nucleotide include a 2'-modified nucleotide obtained by substituting 2'-OH group of the ribose with a substituent selected from the group consisting of OR, R, R'OR, SH, SR, $NH_2$, NHR, $NR_2$, $N_3$, CN, F, Cl, Br, and I (R represents an alkyl or aryl, preferably an alkyl having 1 to 6 carbon atoms, R' represents an alkylene, preferably an alkylene having 1 to 6 carbon atoms and two Rs of $NR_2$ may be the same or different).

As the 2'-modified nucleotide, e.g., 2'-modified nucleotides obtained by substituting the 2'-OH group of the ribose with F and a methoxy group, respectively (referred to as 2'-F modified nucleotide and 2'-O-methyl modified nucleotide, respectively) are preferably used.

An example of the 2'-modified nucleotide is a 2'-modified nucleotide obtained by substituting the 2'-OH group of the ribose with a substituent selected from the group consisting of a 2-(methoxy)ethoxy group, a 3-aminopropoxy group, a 2-[(N,N-dimethylamino)oxy]ethoxy group, a 3-(N,N-dimethylamino)propoxy group, a 2-[2-(N,N-dimethylamino)ethoxy]ethoxy group, 2-(methylamino)-2-oxoethoxy group, 2-(N-methylcarbamoyl)ethoxy group and a 2-cyanoethoxy group An example of the nucleotide modified in the sugar portion is an artificial Bridged Nucleic Acid (BNA) having two ring structures, which are obtained by introducing a cross-linked structure in the sugar portion. Specific examples thereof include an artificial Locked Nucleic Acid (LNA) in which a 2'-position oxygen atom and a 4'-position carbon atom are crosslinked via methylene ([Tetrahedron Letters, 38, 8735, (1997) and Tetrahedron, 54, 3607, (1998)], artificial Ethylene bridged nucleic acid) (ENA) [Nucleic Acid Research, 32, e175 (2004)], Constrained Ethyl (cEt) [The Journal of Organic Chemistry 75, 1569 (2010)], Amido-Bridged Nucleic Acid (AmNA) [Chem Bio Chem 13, 2513 (2012)] and 2'-O, 4'-c-Spirocyclopropylene bridged nucleic acid (scpBNA) [Chem. Commun., 51, 9737 (2015)].

Examples of the nucleotide modified in the sugar portion include a peptide nucleic acid (PNA) [Acc. Chem. Res., 32, 624 (1999)], an oxypeptide nucleic acid (OPNA) [J. Am. Chem. Soc., 123, 4653 (2001)] and a peptide ribonucleic acid (PRNA) [J. Am. Chem. Soc., 122, 6900 (2000)].

As the nucleotide modified in the phosphate diester bond, any nucleotide may be used as long as part or whole of the chemical structure of a phosphate diester bond of the nucleotide is modified or substituted with a substituent or substituted with an atom.

Examples of the nucleotide modified in the phosphate diester bond include a nucleotide obtained by substituting the phosphate diester bond with a phosphorothioate bond, a nucleotide obtained by substituting the phosphate diester bond with a phosphorodithioate bond, a nucleotide obtained by substituting the phosphate diester bond with an alkylphosphonate bond and a nucleotide obtained by substituting the phosphate diester bond with a phosphoramidate bond.

As the nucleotide modified in a base, any nucleotide may be used as long as part or whole of the chemical structure of a base of the nucleotide is modified or substituted with a substituent or substituted with an atom.

Examples of the nucleotide modified in a base include a nucleotide obtained by substituting the oxygen atom in the base with a sulfur atom, a nucleotide obtained by substituting a hydrogen atom with an alkyl group having 1 to 6 carbon atoms or halogen, a nucleotide obtained by substituting the methyl group with hydrogen, hydroxymethyl or an alkyl group having 2 to 6 carbon atoms, and a nucleotide obtained by substituting the amino group with an alkyl group having 1 to 6 carbon atoms, an alkanoyl group having 1 to 6 carbon atoms, an oxo group or a hydroxy group. Note that, using 5-methylcytosine (5-mC) in place of cytosine (C) as a nucleotide modified in a base is a preferable embodiment of the present invention.

Further examples of the nucleotide derivative include nucleotide derivatives obtained by adding, directly or via a linker, to a nucleotide or a nucleotide derivative as mentioned above, a chemical substance such as a ligand; a lipid such as cholesterol, a fatty acid, tocopherol and retinoid; a sugar such as N-acetylgalactosamine (GalNAc), galactose (Gal) and mannose (Man); a full antibody; a fragment antibody such as, Fab, scFv and VHH; a protein such as a low-density lipoprotein (LDL) and human serum albumin; a peptide such as RGD, NGR, R9 and CPP; a low molecule such as phenazine, phenanthridine, anthraquinone and folic acid; a synthetic polymer such as a synthetic polyamino acid; a nucleic acid aptamer; a pigment such as, acridine, fluorescein, rhodamine and coumarin; and a fluorophore such as Cy3 series, Alexa series (registered trademark) and a black hole quencher. Specific examples thereof include a polyamine-added nucleotide derivative, a cholesterol-added nucleotide derivative, a steroid added nucleotide derivative, a GalNAc added nucleotide derivative, a bile acid-added nucleotide derivative, a fatty acid-added nucleotide derivative, a vitamin-added nucleotide derivative, a Cy5 added nucleotide derivative, a Cy3 added nucleotide derivative, a 6-FAM added nucleotide derivative and a biotinylated nucleotide derivative. Preferably, a GalNAc added nucleotide derivative is mentioned. These derivatives can be modified at the 5' end and/or the 3' end, and/or within the sequence by reacting with a reactive modifier on a solid phase during an elongation reaction on the solid phase. Alternatively, a nucleic acid having a functional group such as an amino group, a mercapto group, an azido group, or a triple bond introduced therein, is synthesized and purified in advance; and a modifier may be allowed to react with the functional group.

A nucleotide derivative may have a cross-linked structure, which is formed with another nucleotide within the nucleic acid or a nucleotide derivative, and an alkylene structure, a peptide structure, a nucleotide structure, an ether structure, an ester structure, and a structure consisting of at least two of these, in combination.

The nucleic acid of the present invention includes a nucleic acid obtained by substituting part or all atoms in the nucleic acid molecule with an atom (isotope) different in mass number.

As used herein, "complementary" refers to the relationship between two bases that can be paired, for example, the relationship between adenine and thymine or uracil and the relationship between guanine and cytosine. Likewise, complementary bases are paired through a gentle hydrogen bond and form a double helix structure in the whole double-strand region. In the relationship between adenine and thymine or uracil and the relationship between guanine and cytosine, even though at least one of the bases in each of pairs of A and T (U) and G and C is a modified base, if the base pairing can be formed via a gentle hydrogen bond between two bases, the relationship between these bases can be complementary.

As used herein, "complementary" means not only the case where two nucleotide sequences are completely complementary but also the cases where a mismatch ratio between two nucleotide sequences is 0 to 30%, preferably 0 to 20% and more preferably 0 to 10%. More specifically, an antisense-strand nucleic acid complementary to the APCS mRNA sequence includes a completely complementary base sequence with a partial base sequence of the mRNA or a base sequence having a substitution(s) of one or more bases in the completely complementary base sequence. The antisense-strand nucleic acid may have 1 to 8, preferably 1 to 6, more preferably 1 to 4, further preferably 1 to 3, particularly preferably 1 to 2, particularly more preferably a single mismatch base with the target sequence of a target gene.

More specifically, in the case of the antisense-strand nucleic acid having a chain length of 21 nucleotides (21 base length), the number of mismatch bases with the target nucleotide sequence of a target gene may be 1 to 6, preferably 1 to 5, more preferably 1 to 4, further preferably 1 to 3, particularly preferably 1 to 2 and particularly more preferably a single. The mismatch position may be 5' end or the 3' end of each of the nucleotide sequences of antisense-strands.

As used herein, "complementary" refers to a case where one of the two nucleotide sequences is completely complementary to the other nucleotide sequence; however, the complementary sequence having addition and/or deletion of one or more bases is also included. In the present invention, the antisense-strand nucleic acid is a completely complementary base sequence to the APCS mRNA sequence; however, the antisense-strand nucleic acid may have additional bases, in other words, a single or two bulge bases to a target APCS mRNA sequence.

In the present invention, an antisense-strand nucleic acid or a sense-strand nucleic acid may have a single or two bulge bases.

In the present invention, the "bulge base" refers to a base which does not form a complementary base pair with the other nucleotide sequence.

As the antisense-strand nucleic acid of the present invention, a nucleic acid comprising a completely complementary base sequence with a target APCS mRNA sequence is used; however, the same nucleic acid as the above nucleic acid except that deletion, substitution or addition of 1 to 3 bases, preferably 1 to 2 bases and more preferably a single base are present, may be used.

The nucleic acid that suppresses expression of APCS, which is preferably used is double-stranded nucleic acid, which consists of a single-stranded nucleic acid being a nucleic acid (antisense-strand nucleic acid) comprising a base sequence complementary to a target APCS mRNA sequence or a nucleic acid (antisense-strand nucleic acid) comprising a base sequence complementary to a target APCS mRNA sequence, and a nucleic acid (sense-strand nucleic acid) comprising a base sequence complementary to the base sequence of the nucleic acid.

In the present invention, expression of APCS gene can be suppressed by the antisense-strand nucleic acid.

The double-stranded nucleic acid of the present invention is a double-stranded nucleic acid consisting of a sense-strand nucleic acid and an antisense-strand nucleic acid and comprising a double-strand region having at least 11 base pairs, for suppressing expression of APCS gene, in which an oligonucleotide chain having a chain length of at least 17 nucleotides and at most 30 nucleotides in the antisense-strand nucleic acid, is complementary to a targets APCS mRNA sequence comprising a base sequence set forth in any one of SEQ ID NOS: 1288 to 1930.

The base sequence set forth in any one of SEQ ID NOS: 1288 to 1930 is listed in Table 1.

In the double-stranded nucleic acid of the present invention, the sense-strand nucleic acid and the antisense-strand nucleic acid each may be constituted of any nucleotides or nucleotide derivatives.

The antisense-strand nucleic acid used in the double-stranded nucleic acid of the present invention is a nucleotide chain comprising a base sequence complementary to a target APCS mRNA sequence.

The target APCS mRNA sequence is homologous with SEQ ID NO: 1 and comprises a base sequence set forth in any one of SEQ ID NOS: 1288 to 1930 of the APCS mRNA sequences wherein T in SEQ ID NO: 1 is replaced by U. Preferably, the target APCS mRNA sequence is homologous with SEQ ID NO: 1 and a base sequence set forth in any one of SEQ ID NOS: 1288 to 1930 of the base sequences of APCS mRNA wherein T in SEQ ID NO: 1 is replaced by U.

In the double-stranded nucleic acid of the present invention, an oligonucleotide chain having a chain length of at least 17 nucleotides and at most 30 nucleotides, which constitute the antisense-strand nucleic acid, is complementary to the target APCS mRNA sequence.

In the present invention, an oligonucleotide chain having a chain length of preferably 11 to 27 nucleotides, more preferably 15 to 25 nucleotides, further preferably 15 to 23 nucleotides, particularly preferably 17 to 21 nucleotides, particularly more preferably 17 to 19 nucleotides and particularly further preferably 19 nucleotides, which constitute an antisense-strand nucleic acid, is complementary to the target APCS mRNA sequence.

In the present invention, the antisense-strand nucleic acid and the sense-strand nucleic acid comprise a double-strand region having at least 11 base pairs, usually 11 to 30 nucleotides, preferably 11 to 27 base pairs, more preferably 15 to 25 base pairs, further preferably 15 to 23 base pairs, particularly preferably 17 to 21 base pairs, particularly more preferably 17 to 19 base pairs, and particularly further preferably 19 base pairs.

In the present invention, a 2'-modified nucleotide is preferably contained in the nucleotides in the double-strand region and may be present in any site thereof. The suitable content of the 2'-modified nucleotide may be 10 to 20%, 20 to 40% and 40 to 65% based on the total amount (100%) of the nucleotides.

A specific example of the double-stranded nucleic acid containing a 2'-modified nucleotide is a double-stranded nucleic acid consisting of a pair of sense-strand/antisense-strand sequences selected from the group consisting of the sense-strands/antisense-strands listed in Table 3.

In the present invention, the suitable content of the 2'-modified nucleotide relative to the sense-strand nucleic acid may be 20 to 40%, 40 to 60% or 60% to 100%.

In the present invention, the suitable content of the 2'-modified nucleotide relative to the antisense-strand nucleic acid may be preferably 0 to 40%, 10 to 20% or 20 to 40%.

An antisense-strand nucleic acid and sense-strand nucleic acid (as a single strand) constituting a double-stranded nucleic acid each usually consist of 17 to 30 bases and preferably 17 to 27 bases, more preferably 17 to 25 bases, further preferably 17 to 25 bases and particularly preferably 19 to 25 bases. The base length of the antisense-strand nucleic acid and sense-strand nucleic acid may be the same or different.

In the present invention, the antisense-strand nucleic acid preferably comprises a base sequence set forth in any one of SEQ ID NOS: 645 to 1287 and 1975 to 2018; and the sense-strand nucleic acid preferably comprises a base sequence set forth in any one of SEQ ID NOS: 2 to 644 and 1931 to 1974.

In the present invention, the antisense-strand nucleic acid is more preferably a nucleotide strand having a base sequence set forth in any one of SEQ ID NOS: 645 to 1287 and 1975 to 2018; whereas the sense-strand nucleic acid is more preferably a nucleotide strand having a base sequence set forth in any one of SEQ ID NOS: 2 to 644 and 1931 to 1974.

In the double-stranded nucleic acid of the present invention, the sense-strand nucleic acid comprises a base sequence set forth in any one of SEQ ID NOS: 2 to 644 and 1931 to 1974; and correspondingly thereto, the antisense-strand nucleic acid preferably comprises a base sequence set forth in any one of SEQ ID NOS: 645 to 1287 and 1975 to 2018.

As used herein, the phrase "correspondingly thereto" means a combination of the sense-strand nucleic acid and the antisense-strand nucleic acid described in the each column of double-stranded nucleic acid numbers in Table 1 or Table 3, and SEQ ID NO: n (n=2 to 644) corresponds to SEQ ID NO: n+643. To give a specific example, SEQ ID NO: 2 corresponds to SEQ ID NO: 645.

In the double-stranded nucleic acid of the present invention, it is more preferable that a sense-strand nucleic acid is a nucleotide chain having a base sequence set forth in any one of SEQ ID NOS: 2 to 644 and 1931 to 1974; and correspondingly thereto, the antisense-strand nucleic acid is a nucleotide chain having a base sequence set forth in any one of SEQ ID NOS: 645 to 1287 and 1975 to 2018.

The double-stranded nucleic acid of the present invention has a double-strand region followed by an (additional) nucleotide or nucleotide derivative forming no double strand at the 3'-end side or the 5'-end side, the nucleotide or nucleotide derivative forming no double strand is called as a protrusion (overhang). If an overhang is present, the nucleotides constituting the overhang may be ribonucleotides, deoxyribonucleotides or derivatives of these.

As the double-stranded nucleic acid having an overhang, a double-stranded nucleic acid having an overhang consisting of usually 1 to 6 bases and preferably 1 to 3 bases at the 3' end or the 5' end of at least one of the sense-strand nucleic acid and antisense-strand nucleic acid, is used. A double-stranded nucleic acid having an overhang consisting of 2 bases is more preferably used, and an example thereof is a double-stranded nucleic acid having an overhang consisting of dTdT (dT represents thymidine) or UU. The overhang can be present in an antisense-strand nucleic acid alone or a sense-strand nucleic acid alone and both of the antisense-strand nucleic acid and the sense-strand nucleic acid. In any one of the cases where the overhang is present at an antisense-strand nucleic acid alone, a sense-strand nucleic acid alone and both of the antisense-strand nucleic acid and the sense-strand nucleic acid, the overhang may be present at the 3' end and/or the 5' end of the nucleic acid.

The antisense-strand nucleic acid to be used in the present invention, preferably, an oligonucleotide chain consisting of at least 17 nucleotides and at most 30 nucleotides including a double-strand region with the sense-strand nucleic acid and the following overhang is sufficiently complementary to a target APCS mRNA sequence comprising a base sequence set forth in any one of SEQ ID NOS: 1288 to 1930.

Examples of the double-stranded nucleic acid of the present invention that can be used include a nucleic acid molecule (WO2005/089287) producing the aforementioned double-stranded nucleic acid by the action of a ribonuclease such as Dicer; a double-stranded nucleic acid having a blunt end without an overhang at the 3' end or the 5' end; and a double-stranded nucleic acid (US2012/0040459) having an overhang of only a sense-strand nucleic acid. In the present invention, the "blunt end" means an end of a double-stranded nucleic acid having no overhang. The blunt end refers to, for example, a double-stranded nucleic acid where both the 3' end of a sense-strand nucleic acid and the 5' end of the antisense-strand nucleic acid have no overhang and/or both the 5' end of the sense-strand nucleic acid and the 3' end of the antisense-strand nucleic acid have no overhang.

In the present invention, it is preferable that both of the 3' end of a sense-strand nucleic acid and the 5' end of the antisense-strand nucleic acid and/or both of the 5' end of the sense-strand nucleic acid and the 3' end of the antisense-strand nucleic acid form a blunt end(s). Particularly, it is more preferable that the 3' end of a sense-strand nucleic acid and the 5' end of the antisense-strand nucleic acid, or the 5' end of the sense-strand nucleic acid and the 3' end of the antisense-strand nucleic acid forms a blunt end. If the 3' end of a sense-strand nucleic acid and the 5' end of the antisense-strand nucleic acid and/or the 5' end of the sense-strand nucleic acid and the 3' end of the antisense-strand nucleic acid form a blunt end(s), it is preferable that the sense-strand nucleic acid has a chain length of 21 nucleotides; whereas the antisense-strand nucleic acid has a chain length of 23 nucleotides.

In the present invention, it is also preferable that a double-stranded nucleic acid having an overhang at both of the antisense-strand nucleic acid and sense-strand nucleic acid. It is preferable that the 3' end of the sense-strand nucleic acid and the 3' end of the antisense-strand nucleic acid or the 5' end of the sense-strand nucleic acid and the 5' end of the antisense-strand nucleic acid have an overhang. If both of the antisense-strand nucleic acid and sense-strand nucleic acid have an overhang, it is preferable that the sense-strand nucleic acid has a chain length of 21 nucleotides and the antisense-strand nucleic acid has a chain length of 21 nucleotides.

In the present invention, it is more preferable that both of the 3' end and the 5' end of the sense-strand nucleic acid or both of the 3' end and the 5' end of the antisense-strand nucleic acid have an overhang.

It is preferable that the nucleotide at position 2 counted from the 5' end of an antisense-strand nucleic acid of the present invention is completely complementary to the ribonucleotide at position 2 counted from the 3' end of a target APCS mRNA sequence. It is more preferable that the ribonucleotides at positions 2 to 7 counted from the 5' end of the antisense-strand nucleic acid are completely complementary to the ribonucleotides at positions 2 to 7 counted from the 3' end of the target APCS mRNA sequence, respectively. It is further preferable that the ribonucleotides at positions 2 to 11 counted from the 5' end of the antisense-strand nucleic acid are completely complementary to the ribonucleotides at positions 2 to 11 counted from the 3' end of the target APCS mRNA sequence, respectively.

It is preferable that the nucleotide at position 11 counted from the 5' end of an antisense-strand nucleic acid of the present invention is completely complementary to the ribonucleotide at position 11 counted from the 3' end of a target APCS mRNA sequence. It is more preferable that the ribonucleotides at positions 9 to 13 counted from the 5' end of the antisense-strand nucleic acid are completely complementary to the ribonucleotides at positions 9 to 13 counted from the 3' end of the target APCS mRNA sequence, respectively. It is further preferable that the ribonucleotides at positions 7 to 15 counted from the 5' end of the antisense-strand nucleic acid are completely complementary to the ribonucleotides at positions 7 to 15 counted from the 3' end of the target APCS mRNA sequence, respectively.

A method for producing the nucleic acid of the present invention is not particularly limited, and examples thereof include a method using chemical synthesis known in the art and an enzymatic transcription method.

Examples of the method using chemical synthesis known in the art include a phosphoramidite method, phosphorothioate method, phosphotriester method and CEM method [Nucleic Acid Research, 35, 3287 (2007)]. The nucleic acid of the present invention can be synthesized, for example, by ABI3900 high-throughput nucleic acid synthesizer (manufactured by Applied Biosystems). After completion of synthesis, e.g., detachment from a solid phase, deprotection of a protecting group and purification of a desired product are carried out. It is desirable to obtain a nucleic acid having a purity 90% or more and preferably 95% or more by purification.

In the case of a double-stranded nucleic acid, the sense-strand nucleic acid and antisense-strand nucleic acid synthesized and purified are mixed in an appropriate ratio; for example, 0.1 to 10 equivalents, preferably 0.5 to 2 equivalents, more preferably 0.9 to 1.1 equivalents, and further preferably, 1 equivalent of the sense-strand nucleic acid is mixed with 1 equivalent of the antisense-strand nucleic acid. After mixing, the mixture is usually subjected to annealing; however, the annealing step may be skipped, and the mixture may be directly used.

The annealing may be carried out in any conditions as long as a double-stranded nucleic acid can be formed. The annealing is usually carried out by mixing an antisense-strand nucleic acid and a sense-strand nucleic acid in an almost equimolar ratio, heating the mixture at about 94° C. for about 5 minutes, and slowly cooled up to room temperature.

An example of the enzymatic transcription is a transcription method using phage RNA polymerase such as T7 and T3, or SP6RNA polymerase with a plasmid or DNA having a desired base sequence used as a template.

The nucleic acid of the present invention can be introduced into a cell by use of a transfection carrier, preferably, a cationic carrier such as a cationic liposome or directly introduced into a cell by use of a calcium phosphate method, an electroporation method or microinjection method.

The nucleic acid of the present invention may comprise a ligand. The nucleic acid of the present invention may be modified with one or more ligands or fluorophores at the 5' end and/or the 3' end, and/or within the sequence. The nucleic acid modified with a ligand or a fluorophore is also called as a conjugate nucleic acid. Modification can be made at the 5' end and/or the 3' end and/or within the sequence by allowing a reactive modifier to react on a solid phase during an elongation reaction on the solid phase. Alternatively, a nucleic acid having a functional group such as an amino group, a mercapto group, an azido group, or a triple bond introduced herein, is synthesized and purified in advance; and a modifier is allowed to react with the functional group.

In this manner, a conjugate nucleic acid can be obtained. As the ligand, a molecule having an affinity to a biomolecule may be used. Examples of the ligand include a lipid such as cholesterol, a fatty acid, tocopherol and retinoid; a sugar such as N-acetylgalactosamine (GalNAc), galactose (Gal) and mannose (Man); a full antibody; a fragment antibody such as scFV, Fab and VHH; a protein such as a low density lipoprotein (LDL) and human serum albumin; a peptide such as RGD, NGR, R9 and CPP; a low molecule such as folic acid; a synthetic polymer such as a synthetic polyamino acid; and a nucleic acid aptamer. These may be used in combination. Examples of the fluorophore include Cy3 series, Alexa (registered trademark) series, and black hole quencher (registered trademark). Examples of a method for adding a ligand to the nucleic acid of the present invention include, but are not limited to, a method of allowing a modifier, which is capable of reacting on a solid phase to react, during an elongation reaction on the solid phase to modify 5' end, 3' end and/or within the sequence. Alternatively, a nucleic acid having a functional group such as an amino group, a mercapto group, an azido group, or a triple bond introduced herein, is synthesized and purified in advance; and a modifier may be allowed to react with the functional group.

In place of the nucleic acid of the present invention, a vector which expresses the nucleic acid by introducing the vector into a cell may be used. More specifically, an expression vector is constructed by inserting the sequence encoding the nucleic acid of the present invention to downstream of the promoter within the expression vector and introduced into a cell to allow the nucleic acid to express. Examples of the expression vector include pcDNA6.
2-GW/miR (manufactured by Invitrogen), pSilencer 4.
1-CMV (manufactured by Ambion), pSINsi-hH1 DNA (manufactured by Takara Bio Inc.), pSINsi-hU6 DNA (manufactured by Takara Bio Inc.) and pENTR/U6 (manufactured by Invitrogen).

Since the nucleic acid of the present invention is expressed within a cell, using the vector is included in the technical scope of the nucleic acid of the present invention. A recombinant viral vector, which is produced by introducing the sequence encoding the nucleic acid of the present invention into a virus vector downstream the promoter and introducing the vector into a packaging cell, can be used. Examples of the virus vector include a retro virus vector, a lentiviral vector, an adenovirus vector and an adeno-associated virus vector.

2. Nucleic Acid Having an Activity to Suppress APCS Expression

In the present invention, an antisense-strand nucleic acid and a sense-strand nucleic acid can be designed based on the base sequence (SEQ ID NO: 1) of the APCS 2nd strand cDNA of a full-length mRNA of human APCS, which is registered, for example, in the Genbank, under Accession No. NM_001639.3. Note that, based on the comparison between the base sequence of cDNA of a full-length mRNA of human APCS and the base sequence of cDNA of a full-length mRNA of APCS of a non-human species, an antisense-strand nucleic acid and a sense-strand nucleic acid that suppresses expression of APCS mRNA in a non-human species can be designed.

An example of a nucleic acid having APCS expression-suppressing activity is a double-stranded nucleic acid consisting of an antisense-strand nucleic acid of the present invention comprising a complementary base sequence to the APCS mRNA sequence and a sense-strand nucleic acid of the present invention comprising a complementary base sequence to the base sequence of the antisense-strand nucleic acid, and having APCS expression-suppressing activity.

Expression of APCS can be suppressed by introducing the double-stranded nucleic acid of the present invention into a cell. For example, the double-stranded nucleic acid of the present invention is introduced into a cell in a concentration of several pM to several nM and then cultured for 24 hours or more. For example, at the time point of 48 hours after initiation of culture, expression of mRNA of APCS can be suppressed.

The activity to suppress APCS mRNA expression of the double-stranded nucleic acid of the present invention can be evaluated by transfecting e.g., a human cell strain with, e.g., the nucleic acid, by use of, e.g., a cationic liposome, culturing the human cell strain for a predetermined time and thereafter quantifying the expression level of APCS mRNA in the human cell strain.

The activity to suppress APCS mRNA expression of the double-stranded nucleic acid of the present invention can be evaluated by transfecting, e.g., a human cell strain with, e.g., the nucleic acid by use of, e.g., a cationic liposome and culturing for a predetermined time and thereafter quantifying the expression level of APCS mRNA in the human cell strain.

Examples of the nucleic acid having APCS expression-suppressing activity include, other than the above double-stranded nucleic acid, a single-stranded nucleic acid having a base sequence complementary to a part of the base sequence of the APCS mRNA, wherein the single-stranded nucleic acid suppresses expression of APCS. The single-stranded nucleic acid usually consists of 8 to 30 bases, preferably of 12 to 30 bases and more preferably 12 to 20 bases.

An example of the single-stranded nucleic acid is a single-stranded nucleic acid that is the antisense-strand nucleic acid of the double-stranded nucleic acid of the present invention.

Expression of APCS can be suppressed by introducing the antisense-strand nucleic acid of the present invention as a single-stranded nucleic acid into a cell. For example, the single-stranded nucleic acid of the present invention is introduced into a cell in a concentration of several pM to several μM and cultured for 24 hours or more. For example, at the time point of 48 hours after initiation of culture, expression of mRNA of APCS can be suppressed.

The activity to suppress APCS mRNA expression of the antisense-strand nucleic acid of the present invention can be evaluated by transfecting, e.g., a human cell strain with, e.g., the nucleic acid by use of, e.g., a cationic liposome, culturing the human cell strain for a predetermined time and thereafter quantifying the expression level of APCS mRNA in the human cell strain.

3. Pharmaceutical Composition of the Present Invention

The present invention also relates to a pharmaceutical composition comprising a nucleic acid such as a double-stranded nucleic acid and a single-stranded nucleic acid according to the present invention, as an active ingredient. The pharmaceutical composition of the present invention can be used as a therapeutic or prophylactic agent for amyloid-related diseases.

The present invention also provides a method for treating a disorder mediated by APCS-containing amyloid fibrils. In the method of treatment, the nucleic acid of the present invention or the pharmaceutical composition of the present invention is administered to a human in need of such a treatment to successfully treat a disorder mediated by APCS-containing amyloid fibrils.

An example of the disorder mediated by APCS-containing amyloid fibrils is an amyloid-related disease. The double-stranded nucleic acid of the present invention can be used alone in the treatment method; however, the nucleic acid is administered as an active ingredient of the pharmaceutical composition of the present invention to human to successfully produce a medicinal effect, as shown below.

The pharmaceutical composition of the present invention further comprises a carrier effective for allowing the nucleic acid of the present invention to migrate into a cell. Examples of the carrier effective for allowing the nucleic acid to migrate into a cell include a cationic carrier. Examples of the cationic carrier include a cationic liposome and a cationic polymer. As the carrier effective for allowing the nucleic acid to migrate into a cell, a carrier using a virus envelope may be used. Examples of the cationic polymer include JetSI (Qbiogene) and Jet-PEI (polyethyleneimine; Qbiogene). Examples of the carrier using a virus envelope include GenomeOne (HVJ-E liposome; manufactured by Ishihara Sangyo Kaisha, Ltd.).

A pharmaceutical composition comprising the nucleic acid of the present invention and a carrier as mentioned above can be prepared by a method known to those skilled in the art, for example, by mixing an appropriate concentration of a carrier dispersion with a nucleic acid solution. If a cationic carrier is used, since the nucleic acid is usually negatively charged in an aqueous solution, the carrier and the nucleic acid are mixed in an aqueous solution by a routine method to easily and successfully prepare the pharmaceutical composition of the present invention. Examples of the aqueous solvent to be used for preparing a pharmaceutical composition include an electrolyte solution such as water for injection, distilled water for injection and physiological saline; and a sugar solution such as a glucose solution and maltose solution. The conditions such as pH and temperature for preparing the pharmaceutical composition of the present invention can be appropriately selected by those skilled in the art. The pharmaceutical composition is, if necessary, subjected to a dispersion treatment using an ultrasonic disperser or a high pressure emulsifier etc. to obtain a homogeneous composition. Since the optimal method and conditions for preparing a pharmaceutical composition comprising the nucleic acid of the present invention and a carrier vary depending on the carrier to be used, those skilled in the art can select an optimal method depending on the carrier to be used regardless of the above method.

As the pharmaceutical composition of the present invention, for example, composite particles constituted of a nucleic acid and lead particles as components and a composition constituted of composite particles and, if desired, lipid membrane coating the composite particles, can be suitably used. Examples of the lead particles include a lipid assembly, liposomes, emulsion particles, high molecules, metal colloid and a fine particle preparation. Preferably, a liposome is used and more preferably a cationic liposome is used. In the present invention, lead particles may be constituted of a composite of two or more elements selected from, e.g., a lipid assembly, liposomes, emulsion particles, high molecules, metal colloid and a fine particle preparation or a composite constituted of, e.g., a lipid assembly, liposomes, emulsion particles, high molecules, metal colloid and/or a fine particle preparation or another compound (for example, sugar, lipid, and inorganic compound).

Examples of the lipid membrane coating the composite particles include membrane using, e.g., a non-cationic lipid, a lipid inhibiting agglomeration of particles, and a cationic lipid as a constitution component.

The pharmaceutical composition of the present invention can be prepared, for example, in accordance with the method described in International Publication No. WO2006/080118 etc.

With respect to the blending ratio of a nucleic acid and a carrier comprised in the pharmaceutical composition of the present invention, usually 1 to 200 parts by weight of the carrier relative to 1 part by mass of the nucleic acid is appropriate. The blending ratio is preferably 2.5 to 100 parts by mass of a carrier and more preferably 7 to 25 parts by mass of carrier relative to 1 part by mass of the nucleic acid.

The size of the particles constituting the pharmaceutical composition of the present invention in average is preferably about 10 nm to 300 nm, more preferably about 30 nm to 200 nm and further preferably about 50 nm to 150 nm.

The pharmaceutical composition of the present invention may comprise, other than the above carrier, e.g., a pharmaceutically acceptable carrier or a diluent. The pharmaceutically acceptable carrier or diluent is basically a chemically inactive and harmless compound (including a composition) and having no influence on the biological activity of the pharmaceutical composition of the present invention. Examples of the pharmaceutically acceptable carrier or diluent include, but are not particularly limited to, a salt solution, a sugar solution, a glycerol solution and ethanol.

The pharmaceutical composition of the present invention comprises a nucleic acid in an amount effective for treating or preventing a disease and is provided in a form appropriate for administering to patients. Examples of the dosage form of the pharmaceutical composition of the present invention may include a liquid such as an injection, an eye drop and an inhalation; and a topical preparation such as an ointment and a lotion.

In the case of a liquid, the concentration of the nucleic acid of the present invention serving as an active ingredient in the pharmaceutical composition of the present invention usually falls within the range of 0.001 to 25% (w/v), preferably 0.1 to 10% (w/v) and more preferably 0.5 to 5% (w/v). The pharmaceutical composition of the present invention may comprise any pharmaceutically acceptable additives such as an emulsifying aid, a stabilizer, a tonicity agent and/or a pH regulator in appropriate amounts. The pharmaceutically acceptable additives can be added in an appropriate step before and after dispersion of the composite.

The pH of the liquid is usually controlled within the range of about 5.0 to about 8.5 and preferably about 6.0 to about 8.0.

The liquid is preferably subjected to a sterilization treatment such as sterilization by filtration using, e.g., a membrane filter.

The pharmaceutical composition of the present invention can be prepared as a lyophilized preparation. The lyophilized preparation can be prepared by dispersing a nucleic acid and a carrier and lyophilizing the dispersion. The lyophilization can be carried out by a routine method. For example, a predetermined amount of a complex solution dispersed is dispensed in vials in aseptic conditions. The vials are subjected to a pre-drying process at about −40 to −20° C. for about 2 hours, a primary drying process at about 0 to 10° C. under reduced pressure and then a secondary drying process at about 15 to 25° C. under reduced pressure. In this manner, freeze drying can be carried out. Subsequently, the inner atmosphere of the vials is purged with nitrogen gas and a stopper is put on the vials. In this manner, the lyophilized preparation of the pharmaceutical composition of the present invention can be obtained.

The lyophilized preparation can be dissolved again by adding an appropriate solution and put in use. Examples of the solution include water for injection, an electrolyte solution such as and physiological saline; and a glucose solution and other general infusion. The volume of the solution to be used, which varies depending on, e.g., the application. Although it is not particularly limited, the volume is preferably 0.5 to 2 fold as large as the volume before freeze-drying, or 500 mL or less.

The pharmaceutical composition of the present invention can be dosed by intravenous administration, intraarterial administration, oral administration, intra-tissue administration, transdermal administration, transmucosal administration, or rectal administration; however, the composition is preferably dosed by a method appropriate for the symptom of the patient. Particularly intravenous administration, transdermal administration, and transmucosal administration are preferably used. Topical administration such as local administration within, e.g., cancer, can be made. Examples of the dosage form suitable for these administration methods include injections, oral preparations, intravenous fluids, absorbing agents, eye-drops, ointments, lotions and suppositories.

The dose of the pharmaceutical composition of the present invention is desirably determined in consideration of, e.g., the type of drug, dosage form, the state of the patient such as age and body weight; route of administration, and the nature and condition of the disease; however, the dose is usually 0.1 mg to 10 g/day per adult, preferably 1 mg to 500 mg/day per adult, in terms of mass of the nucleic acid. In some cases, the above dose or less is sufficient; on the contrary, the above dose or more is required in other cases. The pharmaceutical composition of the present invention can be administered once to several times at intervals of a single to several days.

EXAMPLES

Now, the present invention will be described by way of Examples; however, the present invention is not limited by these Examples.

Example 1: Synthesis of Double-Stranded Nucleic Acid

Synthesis of sense-strand nucleic acids consisting of the ribonucleotides set forth in SEQ ID NOS: 2 to 644 and antisense-strand nucleic acids consisting of the ribonucleotides set forth in SEQ ID NOS: 645 to 1287 were outsourced to Sigma Aldrich and double-stranded nucleic acids were prepared by annealing them (the sense-strand nucleic acids set forth in SEQ ID NO: n (n=2 to 644) and the antisense-strand nucleic acids set forth in SEQ ID NO: [n+643] are paired).

Example 2: Measurement of APCS mRNA Knockdown Activity

To 384-well culture plates, the double-stranded nucleic acids synthesized in Example 1 and a siRNA/RNAiMax mixture (20 µL) prepared by diluting RNAiMax transfection reagent (manufactured by Thermo Fisher Scientific, catalog number 13778150) with Opti-MEM I Reduced Serum Medium culture medium (manufactured by Thermo Fisher Scientific, catalog number 31985070) were added. A human ovarian cancer-derived cell strain, RMG-I cells (JCRB cell bank, JCRB0172) were seeded so as to be 10,000 cells/40 µL/well to each of the 384-well culture plates and incubated at 37° C. in 5% $CO_2$ condition for 24 hours. The culture medium used herein was Ham's F-12 Nutrient Mix culture medium (manufactured by Thermo Fisher Scientific, catalog number 11765-047) containing 10% fetal bovine serum (manufactured by Thermo Fisher Scientific, catalog number 10091-148). The final concentration of each of the double-stranded nucleic acids was set at 1 nM. Thereafter, the cells were washed with DPBS (no calcium, no magnesium) (manufactured by Thermo Fisher Scientific, catalog number 14190-144), and then, cDNA was synthesized from each of the plates by TaqMan (registered trademark) Fast Cells-to-CT (trademark) kit (manufactured by Thermo Fisher Scientific, catalog number 4399003) in accordance with the following method. A solution, which was prepared by mixing Lysis solution (contained in the kit) and DNase I (contained in the kit) in a ratio of 100:1, was added by 10 µL for each and the mixture was stirred for 5 minutes. Stop Solution (contained in the kit) was added by 1 µL for each. The mixture was stirred for 2 minutes to obtain an RNA extract. Then, 5 µL of 2×RT Buffer (contained in the kit), 0.5 µL of 20×RT Enzyme Mix (contained in the kit), 2.5 µL of Nuclease-free Water and 2 µL of the RNA extract were mixed. The mixture was allowed to react at 37° C. for 60 minutes and at 95° C. for 5 minutes to synthesize cDNA. The cDNA (2 µL) was added to MicroAmp (registered trademark) EnduraPlate (trademark) Optical 384-Well Clear Reaction Plates with Barcode (manufactured by Thermo Fisher Scientific, catalog number 4483285), and further 5 µL of TaqMan (registered trademark) Fast Universal PCR Master Mix (manufactured by Thermo Fisher Scientific, catalog number 4352042), 2.5 µL of DISTILLED WATER (ULTRAPURE) (manufactured by Thermo Fisher Scientific, catalog number 10977015), 0.25 µL of human APCS probe and 0.25 µL of human ACTB probe were added. Using QuantStudio (trademark) 7 Flex, human APCS gene and human ACTB (actin beta) gene were subjected to real time PCR. The expression level of ACTB as an expressible constituent gene was measured as the internal control and the APCS gene-expression level was corrected. Based on the APCS mRNA amount, which was obtained in the case where RMG-I cells were treated by a transfection reagent alone without using siRNA and specified as 1.0, the relative expression levels of APCS mRNAs of the cells to which individual siRNAs were introduced, were calculated. This experiment was repeated twice. The smallest relative expression levels of APCS mRNAs are shown in Table 1. For convenience sake, Table 1 will be separately shown as follows.

TABLE 1

| Double stranded nucleic acid No. | Sense strand sequence (5'--->3') | SEQ ID NO: | Antisense strand sequence (5'--->3') | SEQ ID NO: | Target APCS mRNA sequence | APCS relative expression level |
|---|---|---|---|---|---|---|
| AH0001 | GCAUGAAUAUCAGACGCUAGG | SEQ ID NO: 2 | UAGCGUCUGAUAUUCAUGCCC | SEQ ID NO: 645 | GCAUGAAUAUCAGACGCUA | 0.305 |
| AH0002 | CAUGAAUAUCAGACGCUAGGG | SEQ ID NO: 3 | CUUAGCGUCUGAUAUUCAUGCC | SEQ ID NO: 646 | CAUGAAUAUCAGACGCUAG | 0.391 |
| AH0003 | AUAUCAGACGCUAGGGGACA | SEQ ID NO: 4 | UCCCCCUAGCGUCUGAUAUUC | SEQ ID NO: 647 | AUAUCAGACGCUAGGGGGA | 0.427 |
| AH0004 | CUAGGGGACAGCCACUGUGU | SEQ ID NO: 5 | ACAGUGGCUGUCCCCCUAGCG | SEQ ID NO: 648 | CUAGGGGACAGCCACUGU | 0.405 |
| AH0005 | AGGGGACAGCCACUGUGUUG | SEQ ID NO: 6 | ACCACAGUGGCUGUCCCCUAG | SEQ ID NO: 649 | AGGGGACAGCCACUGUGU | 0.401 |
| AH0006 | GGGGACAGCCACUGUGUUGUC | SEQ ID NO: 7 | CAACACAGUGGCUGUCCCCCU | SEQ ID NO: 650 | GGGGACAGCCACUGUGUUG | 0.456 |
| AH0007 | GGGACAGCCACUGUGUUGUCU | SEQ ID NO: 8 | ACAACACAGUGGCUGUCCCCC | SEQ ID NO: 651 | GGGACAGCCACUGUGUGU | 0.435 |
| AH0008 | GGACAGCCACUGUGUUGUCUG | SEQ ID NO: 9 | GACAACACAGUGGCUGUCCCC | SEQ ID NO: 652 | GGACAGCCACUGUGUUGUC | 0.436 |
| AH0009 | GACAGCCACUGUGUUGUCUGC | SEQ ID NO: 10 | AGACAACACAGUGGCUGUCCC | SEQ ID NO: 653 | GACAGCCACUGUGUUGUCU | 0.487 |
| AH0010 | GCCACUGUGUUGUCUGCUACC | SEQ ID NO: 11 | UAGCAGACAACACAGUGGCUG | SEQ ID NO: 654 | GCCACUGUGUUGUCUGCUA | 0.288 |
| AH0011 | CCACUGUGUUGUCUGCUACCC | SEQ ID NO: 12 | GUAGCAGACAACACAGUGGCU | SEQ ID NO: 655 | CCACUGUGUUGUCUGCUAC | 0.382 |
| AH0012 | CACUGUGUUGUCUGCUACCCU | SEQ ID NO: 13 | GGUAGCAGACAACACAGUGGC | SEQ ID NO: 656 | CACUGUGUUGUCUGCUACC | 0.490 |
| AH0013 | CUGUGUUGUCUGCUACCCUCA | SEQ ID NO: 14 | AGGGUAGCAGACAACACAGUG | SEQ ID NO: 657 | CUGUGUUGUCUGCUACCCU | 0.315 |
| AH0014 | UGUGUUGUCUGCUACCCUCAU | SEQ ID NO: 15 | GAGGGUAGCAGACAACACAGU | SEQ ID NO: 658 | UGUGUUGUCUGCUACCCUC | 0.360 |
| AH0015 | GUGUUGUCUGCUACCCUCAUC | SEQ ID NO: 16 | UGAGGGUAGCAGACAACACAG | SEQ ID NO: 659 | GUGUUGUCUGCUACCCUCA | 0.275 |
| AH0016 | UGUUGUCUGCUACCCUCAUCC | SEQ ID NO: 17 | AUGAGGGUAGCAGACAACACA | SEQ ID NO: 660 | UGUUGUCUGCUACCCUCAU | 0.259 |
| AH0017 | GUUGUCUGCUACCCUCAUCCU | SEQ ID NO: 18 | GAUGAGGGUAGCAGACAACAC | SEQ ID NO: 661 | GUUGUCUGCUACCCUCAUC | 0.345 |
| AH0018 | GUCUGCUACCCUCAUCCUGGU | SEQ ID NO: 19 | CAGGAUGAGGGUAGCAGACAA | SEQ ID NO: 662 | GUCUGCUACCCUCAUCCUG | 0.406 |
| AH0019 | CUGCUACCCUCAUCCUGGUCA | SEQ ID NO: 20 | ACCAGGAUGAGGGUAGCAGAC | SEQ ID NO: 663 | CUGCUACCCUCAUCCUGGU | 0.229 |
| AH0020 | GCUACCCUCAUCCUGGUCACU | SEQ ID NO: 21 | UGACCAGGAUGAGGGUAGCAG | SEQ ID NO: 664 | GCUACCCUCAUCCUGGUCA | 0.278 |
| AH0021 | CUACCCUCAUCCUGGUCACUG | SEQ ID NO: 22 | GUGACCAGGAUGAGGGUAGCA | SEQ ID NO: 665 | CUACCCUCAUCCUGGUCAC | 0.284 |
| AH0022 | UACCCUCAUCCUGGUCACUGC | SEQ ID NO: 23 | AGUGACCAGGAUGAGGGUAGC | SEQ ID NO: 666 | UACCCUCAUCCUGGUCACU | 0.234 |
| AH0023 | ACCCUCAUCCUGGUCACUGCU | SEQ ID NO: 24 | CAGUGACCAGGAUGAGGGUAG | SEQ ID NO: 667 | ACCCUCAUCCUGGUCACUG | 0.413 |

TABLE 1-continued

| Double stranded nucleic acid No. | SEQ ID NO: | Sense strand sequence (5'--->3') | SEQ ID NO: | Antisense strand sequence (5'--->3') | SEQ ID NO: | Target APCS mRNA sequence | APCS relative expression level |
|---|---|---|---|---|---|---|---|
| AH0024 | SEQ ID NO: 25 | CCCUCAUCCUGGUCACUGCUU | SEQ ID NO: 668 | GCAGUGACCAGGAUGAGGGUA | SEQ ID NO: 1311 | CCCUCAUCCUGGUCACUGC | 0.268 |
| AH0025 | SEQ ID NO: 26 | CCUCAUCCUGGUCACUGCUUC | SEQ ID NO: 669 | AGCAGUGACCAGGAUGAGGGU | SEQ ID NO: 1312 | CCUCAUCCUGGUCACUGCU | 0.232 |
| AH0026 | SEQ ID NO: 27 | CUCAUCCUGGUCACUGCUUCU | SEQ ID NO: 670 | AAGCAGUGACCAGGAUGAGGG | SEQ ID NO: 1313 | CUCAUCCUGGUCACUGCUU | 0.293 |
| AH0027 | SEQ ID NO: 28 | CAUCCUGGUCACUGCUUCUC | SEQ ID NO: 671 | AGAAGCAGUGACCAGGAUGAG | SEQ ID NO: 1314 | CAUCCUGGUCACUGCUUCU | 0.158 |
| AH0028 | SEQ ID NO: 29 | AUCCUGGUCACUGCUUCUCU | SEQ ID NO: 672 | CAGAAGCAGUGACCAGGAUGA | SEQ ID NO: 1315 | AUCCUGGUCACUGCUUCUC | 0.286 |
| AH0029 | SEQ ID NO: 30 | UCCUGGUCACUGCUUCUCUA | SEQ ID NO: 673 | GCAGAAGCAGUGACCAGGAUG | SEQ ID NO: 1316 | UCCUGGUCACUGCUUCUCUG | 0.304 |
| AH0030 | SEQ ID NO: 31 | CCUGGUCACUGCUUCUCUAU | SEQ ID NO: 674 | AGCAGAAGCAGUGACCAGGA | SEQ ID NO: 1317 | CCUGGUCACUGCUUCUCUGCU | 0.083 |
| AH0031 | SEQ ID NO: 32 | CUGGUCACUGCUUCUCUAUA | SEQ ID NO: 675 | UAGCAGAAGCAGUGACCAGGA | SEQ ID NO: 1318 | CUGGUCACUGCUUCUCUGCUA | 0.132 |
| AH0032 | SEQ ID NO: 33 | UGGUCACUGCUUCUCUAUAA | SEQ ID NO: 676 | AUAGCAGAAGCAGUGACCAGG | SEQ ID NO: 1319 | UGGUCACUGCUUCUCUGCUAU | 0.172 |
| AH0033 | SEQ ID NO: 34 | GGUCACUGCUUCUCUAUAAC | SEQ ID NO: 677 | UAUAGCAGAAGCAGUGACCAG | SEQ ID NO: 1320 | GGUCACUGCUUCUCUGCUAUA | 0.117 |
| AH0034 | SEQ ID NO: 35 | GUCACUGCUUCUCUAUAACA | SEQ ID NO: 678 | UUAUAGCAGAAGCAGUGACCA | SEQ ID NO: 1321 | GUCACUGCUUCUCUGCUAUAA | 0.174 |
| AH0035 | SEQ ID NO: 36 | CACUGCUUCUCUAUAACAGC | SEQ ID NO: 679 | UGUUAUAGCAGAAGCAGUGAC | SEQ ID NO: 1322 | CACUGCUUCUCUGCUAUAACA | 0.082 |
| AH0036 | SEQ ID NO: 37 | ACUGCUUCUCUAUAACAGCC | SEQ ID NO: 680 | CUGUUAUAGCAGAAGCAGUGA | SEQ ID NO: 1323 | ACUGCUUCUCUGCUAUAACAG | 0.215 |
| AH0037 | SEQ ID NO: 38 | CUGCUUCUCUAUAACAGCCC | SEQ ID NO: 681 | GCUGUUAUAGCAGAAGCAGUG | SEQ ID NO: 1324 | CUGCUUCUCUGCUAUAACAGC | 0.082 |
| AH0038 | SEQ ID NO: 39 | GCUUCUCUAUAACAGCCCUA | SEQ ID NO: 682 | GGGCUGUUAUAGCAGAAGCAG | SEQ ID NO: 1325 | GCUUCUCUGCUAUAACAGCCC | 0.205 |
| AH0039 | SEQ ID NO: 40 | CUUCUCUAUAACAGCCCUAG | SEQ ID NO: 683 | AGGGCUGUUAUAGCAGAAGCA | SEQ ID NO: 1326 | CUUCUCUGCUAUAACAGCCCU | 0.165 |
| AH0040 | SEQ ID NO: 41 | UUCUCUAUAACAGCCCUAGG | SEQ ID NO: 684 | UAGGGCUGUUAUAGCAGAAGC | SEQ ID NO: 1327 | UUCUCUGCUAUAACAGCCCUA | 0.148 |
| AH0041 | SEQ ID NO: 42 | UCUCUAUAACAGCCCUAGGC | SEQ ID NO: 685 | CUAGGGCUGUUAUAGCAGAAG | SEQ ID NO: 1328 | UCUCUGCUAUAACAGCCCUAG | 0.371 |
| AH0042 | SEQ ID NO: 43 | CUCUAUAACAGCCCUAGGCC | SEQ ID NO: 686 | CCUAGGGCUGUUAUAGCAGAA | SEQ ID NO: 1329 | CUCUGCUAUAACAGCCCUAGG | 0.203 |
| AH0043 | SEQ ID NO: 44 | UCUAUAACAGCCCUAGGCCA | SEQ ID NO: 687 | GCCUAGGGCUGUUAUAGCAGA | SEQ ID NO: 1330 | UCUGCUAUAACAGCCCUAGGC | 0.419 |
| AH0044 | SEQ ID NO: 45 | CUAUAACAGCCCUAGGCCAG | SEQ ID NO: 688 | GGCCUAGGGCUGUUAUAGCAG | SEQ ID NO: 1331 | CUGCUAUAACAGCCCUAGGCC | 0.457 |
| AH0045 | SEQ ID NO: 46 | CUAUAACAGCCCUAGGCCAGG | SEQ ID NO: 689 | UGGCCUAGGGCUGUUUAUAGCA | SEQ ID NO: 1332 | CUAUAACAGCCCUAGGCCA | 0.115 |
| AH0046 | SEQ ID NO: 47 | UAUAACAGCCCUAGGCCAGGA | SEQ ID NO: 690 | CUGGCCUAGGGCUGUUUAUAG | SEQ ID NO: 1333 | UAUAACAGCCCUAGGCCAG | 0.300 |
| AH0047 | SEQ ID NO: 48 | AUAACAGCCCUAGGCCAGGAA | SEQ ID NO: 691 | CCUGGCCUAGGGCUGUUAUAG | SEQ ID NO: 1334 | AUAACAGCCCUAGGCCAGG | 0.396 |

TABLE 1-continued

| Double stranded nucleic acid No. | Sense strand sequence (5'--->3') | SEQ ID NO: | Antisense strand sequence (5'--->3') | SEQ ID NO: | Target APCS mRNA sequence | APCS relative expression level |
|---|---|---|---|---|---|---|
| AH0048 | UAACAGCCCUAGGCCAGGAAU | SEQ ID NO: 49 | UCCUGGCCUAGGGCUGUUAUA | SEQ ID NO: 692 | UAACAGCCCUAGGCCAGGA | 0.479 |
| AH0049 | ACACAGCCCUAGGCCAGGAAUAU | SEQ ID NO: 50 | AUAUCCUGGCCUAGGGCUGUUA | SEQ ID NO: 693 | ACAGCCCUAGGCCAGGAAU | 0.283 |
| AH0050 | CAGCCCUAGGCCAGGAAUAUG | SEQ ID NO: 51 | UAUUCCUGGCCUAGGGCUGUU | SEQ ID NO: 694 | CAGCCCUAGGCCAGGAAUA | 0.293 |
| AH0051 | AGCCCUAGGCCAGGAAUAUGA | SEQ ID NO: 52 | AUAUUCCUGGCCUAGGGCUGU | SEQ ID NO: 695 | AGCCCUAGGCCAGGAAUAU | 0.220 |
| AH0052 | GCCCUAGGCCAGGAAUAUGAA | SEQ ID NO: 53 | CAUAUUCCUGGCCUAGGGCUG | SEQ ID NO: 696 | GCCCUAGGCCAGGAAUAUG | 0.189 |
| AH0053 | CCCUAGGCCAGGAAUAUGAAC | SEQ ID NO: 54 | UCAUAUUCCUGGCCUAGGGCU | SEQ ID NO: 697 | CCCUAGGCCAGGAAUAUGA | 0.158 |
| AH0054 | CCUAGGCCAGGAAUAUGAACA | SEQ ID NO: 55 | UUCAUAUUCCUGGCCUAGGGC | SEQ ID NO: 698 | CUAGGCCAGGAAUAUGAA | 0.188 |
| AH0055 | CUAGGCCAGGAAUAUGAACAA | SEQ ID NO: 56 | GUUCAUAUUCCUGGCCUAGGG | SEQ ID NO: 699 | CUAGGCCAGGAAUAUGAAC | 0.433 |
| AH0056 | UAGGCCAGGAAUAUGAACAAG | SEQ ID NO: 57 | UGUUCAUAUUCCUGGCCUAGG | SEQ ID NO: 700 | UAGGCCAGGAAUAUGAACA | 0.242 |
| AH0057 | AGGCCAGGAAUAUGAACAAGC | SEQ ID NO: 58 | UUGUUCAUAUUCCUGGCCUA | SEQ ID NO: 701 | AGGCCAGGAAUAUGAACAA | 0.107 |
| AH0058 | GGCCAGGAAUAUGAACAAGCC | SEQ ID NO: 59 | CUUGUUCAUAUUCCUGGCCUA | SEQ ID NO: 702 | GGCCAGGAAUAUGAACAAG | 0.428 |
| AH0059 | GCCAGGAAUAUGAACAAGCCG | SEQ ID NO: 60 | GCUUGUUCAUAUUCCUGGCC | SEQ ID NO: 703 | GCCAGGAAUAUGAACAAGC | 0.221 |
| AH0060 | CCAGGAAUAUGAACAAGCCGU | SEQ ID NO: 61 | GGCUUGUUCAUAUUCCUGGC | SEQ ID NO: 704 | CCAGGAAUAUGAACAAGCC | 0.242 |
| AH0061 | CAGGAAUAUGAACAAGCCGCU | SEQ ID NO: 62 | CGGCUUGUUCAUAUUCCUGGC | SEQ ID NO: 705 | CAGGAAUAUGAACAAGCCG | 0.299 |
| AH0062 | AGGAAUAUGAACAAGCCGCUG | SEQ ID NO: 63 | GCGCUUGUUCAUAUUCCUG | SEQ ID NO: 706 | AGGAAUAUGAACAAGCCGC | 0.309 |
| AH0063 | GGAAUAUGAACAAGCCGCUGC | SEQ ID NO: 64 | AGCGGCUUGUUCAUAUUCCU | SEQ ID NO: 707 | GGAAUAUGAACAAGCCGCU | 0.113 |
| AH0064 | GAAUAUGAACAAGCCGCUGCU | SEQ ID NO: 65 | CAGCGGCUUGUUCAUAUUCC | SEQ ID NO: 708 | GAAUAUGAACAAGCCGCUG | 0.103 |
| AH0065 | AAUAUGAACAAGCCGCUGCUU | SEQ ID NO: 66 | GCAGCGGCUUGUUCAUAUUCC | SEQ ID NO: 709 | AAUAUGAACAAGCCGCUGC | 0.444 |
| AH0066 | AUAUGAACAAGCCGCUGCUUU | SEQ ID NO: 67 | AGCAGCGGCUUGUUCAUAUUC | SEQ ID NO: 710 | AUAUGAACAAGCCGCUGCU | 0.198 |
| AH0067 | UAUGAACAAGCCGCUGCUUUG | SEQ ID NO: 68 | AAGCAGCGGCUUGUUCAUAUU | SEQ ID NO: 711 | UAUGAACAAGCCGCUGCUU | 0.464 |
| AH0068 | AUGAACAAGCCGCUGCUUUGG | SEQ ID NO: 69 | AAAGCAGCGGCUUGUUCAUAU | SEQ ID NO: 712 | AUGAACAAGCCGCUGCUUU | 0.190 |
| AH0069 | UGAACAAGCCGCUGCUUUGGA | SEQ ID NO: 70 | CAAAGCAGCGGCUUGUUCAUA | SEQ ID NO: 713 | UGAACAAGCCGCUGCUUUG | 0.150 |
| AH0070 | GAACAAGCCGCUGCUUUGGAU | SEQ ID NO: 71 | CCAAAGCAGCGGCUUGUUCAU | SEQ ID NO: 714 | GAACAAGCCGCUGCUUUGG | 0.149 |
| AH0071 | AACAAGCCGCUGCUUUGGAUC | SEQ ID NO: 72 | UCCAAAGCAGCGGCUUGUUCA | SEQ ID NO: 715 | AACAAGCCGCUGCUUUGGA | 0.180 |

TABLE 1 -continued

| Double stranded nucleic acid No. | SEQ ID NO: | Sense strand sequence (5'--->3') | SEQ ID NO: | Antisense strand sequence (5'--->3') | SEQ ID NO: | Target APCS mRNA sequence | APCS relative expression level |
|---|---|---|---|---|---|---|---|
| AH0072 | SEQ ID NO: 73 | ACAAGCCGCUGCUUUGGAUCU | SEQ ID NO: 716 | AUCCAAAGCAGCCGGCUUGUUC | SEQ ID NO: 1359 | ACAAGCCGCUGCUUUGGAU | 0.078 |
| AH0073 | SEQ ID NO: 74 | CAAGCCGCUGCUUUGGAUCUC | SEQ ID NO: 717 | GAUCCAAAGCAGCGGCUUGUU | SEQ ID NO: 1360 | CAAGCCGCUGCUUUGGAUC | 0.100 |
| AH0074 | SEQ ID NO: 75 | AAGCCGCUGCUUUGGAUCUCU | SEQ ID NO: 718 | AGAUCCAAAGCAGCGGCUUGU | SEQ ID NO: 1361 | AAGCCGCUGCUUUGGAUCU | 0.127 |
| AH0075 | SEQ ID NO: 76 | AGCCGCUGCUUUGGAUCUCUG | SEQ ID NO: 719 | GAGAUCCAAAGCAGCGGCUUG | SEQ ID NO: 1362 | AGCCGCUGCUUUGGAUCUC | 0.123 |
| AH0076 | SEQ ID NO: 77 | GCCGCUGCUUUGGAUCUCUGU | SEQ ID NO: 720 | AGAGAUCCAAAGCAGCCGCUU | SEQ ID NO: 1363 | GCCGCUGCUUUGGAUCUCU | 0.047 |
| AH0077 | SEQ ID NO: 78 | CCGCUGCUUUGGAUCUCUGUC | SEQ ID NO: 721 | CAGAGAUCCAAAGCAGCCGCU | SEQ ID NO: 1364 | CCGCUGCUUUGGAUCUCUG | 0.054 |
| AH0078 | SEQ ID NO: 79 | CGCUGCUUUGGAUCUCUGUCC | SEQ ID NO: 722 | ACAGAGAUCCAAAGCAGCGCGG | SEQ ID NO: 1365 | CGCUGCUUUGGAUCUCUGU | 0.064 |
| AH0079 | SEQ ID NO: 80 | GCUGCUUUGGAUCUCUGUCCU | SEQ ID NO: 723 | GACAGAGAUCCAAAGCAGCG | SEQ ID NO: 1366 | GCUGCUUUGGAUCUCUGUC | 0.090 |
| AH0080 | SEQ ID NO: 81 | CUGCUUUGGAUCUCUGUCCUC | SEQ ID NO: 724 | GGACAGAGAUCCAAAGCAGC | SEQ ID NO: 1367 | CUGCUUUGGAUCUCUGUCC | 0.296 |
| AH0081 | SEQ ID NO: 82 | UGCUUUGGAUCUCUGUCCUCA | SEQ ID NO: 725 | AGGACAGAGAUCCAAAGCAG | SEQ ID NO: 1368 | UGCUUUGGAUCUCUGUCCU | 0.088 |
| AH0082 | SEQ ID NO: 83 | GCUUUGGAUCUCUGUCCUCAC | SEQ ID NO: 726 | GAGGACAGAGAUCCAAAGCA | SEQ ID NO: 1369 | GCUUUGGAUCUCUGUCCUC | 0.131 |
| AH0083 | SEQ ID NO: 84 | CUUUGGAUCUCUGUCCUCACC | SEQ ID NO: 727 | UGAGGACAGAGAUCCAAAGC | SEQ ID NO: 1370 | CUUUGGAUCUCUGUCCUCA | 0.070 |
| AH0084 | SEQ ID NO: 85 | UUUGGAUCUCUGUCCUCACCA | SEQ ID NO: 728 | GUGAGGACAGAGAUCCAAAG | SEQ ID NO: 1371 | UUUGGAUCUCUGUCCUCAC | 0.300 |
| AH0085 | SEQ ID NO: 86 | GGAUCUCUGUCCUCACCAGCC | SEQ ID NO: 729 | CUGGUGAGGACAGAGAUCCAA | SEQ ID NO: 1372 | GGAUCUCUGUCCUCACCAG | 0.129 |
| AH0086 | SEQ ID NO: 87 | GAUCUCUGUCCUCACCAGCCU | SEQ ID NO: 730 | GCUGGUGAGGACAGAGAUCCA | SEQ ID NO: 1373 | GAUCUCUGUCCUCACCAGC | 0.483 |
| AH0087 | SEQ ID NO: 88 | CUCUGUCCUCACCAGCCUCCU | SEQ ID NO: 731 | GAGGCUGGUGAGGACAGAGAU | SEQ ID NO: 1374 | CUCUGUCCUCACCAGCCUC | 0.263 |
| AH0088 | SEQ ID NO: 89 | CUGUCCUCACCAGCCUCCUGG | SEQ ID NO: 732 | AGGAGGCUGGUGAGGACAGAG | SEQ ID NO: 1375 | CUGUCCUCACCAGCCUCCU | 0.413 |
| AH0089 | SEQ ID NO: 90 | UGUCCUCACCAGCCUCCUGA | SEQ ID NO: 733 | CAGGAGGCUGGUGAGGACAGA | SEQ ID NO: 1376 | UGUCCUCACCAGCCUCCUG | 0.334 |
| AH0090 | SEQ ID NO: 91 | GUCCUCACCAGCCUCCUCCUGGAA | SEQ ID NO: 734 | CCAGGAGGCUGGUGAGGACA | SEQ ID NO: 1377 | GUCCUCACCAGCCUCCUGG | 0.295 |
| AH0091 | SEQ ID NO: 92 | UCCUCACCAGCCUCCUGGAAG | SEQ ID NO: 735 | UCCAGGAGGCUGGUGAGGACA | SEQ ID NO: 1378 | UCCUCACCAGCCUCCUGGA | 0.300 |
| AH0092 | SEQ ID NO: 93 | CUCACCAGCCUCCUGGAAGCC | SEQ ID NO: 736 | CUUCCAGGAGGCUGGUGAGGA | SEQ ID NO: 1379 | CUCACCAGCCUCCUGGAAG | 0.243 |
| AH0093 | SEQ ID NO: 94 | UCACCAGCCUCCUGGAAGCCU | SEQ ID NO: 737 | GCUUCCAGGAGGCUGGUGAGG | SEQ ID NO: 1380 | UCACCAGCCUCCUGGAAGC | 0.286 |
| AH0094 | SEQ ID NO: 95 | ACCAGCCUCCUGGAAGCCUU | SEQ ID NO: 738 | AGGCUUCCAGGAGGCUGGUGA | SEQ ID NO: 1381 | ACCAGCCUCCUGGAAGCCU | 0.365 |
| AH0095 | SEQ ID NO: 96 | CCAGCCUCCUGGAAGCCUUG | SEQ ID NO: 739 | AAGGCUUCCAGGAGGCUGGUG | SEQ ID NO: 1382 | CCAGCCUCCUGGAAGCCUU | 0.060 |

TABLE 1-continued

| Double stranded nucleic acid No. | SEQ ID NO: | Sense strand sequence (5'--->3') | SEQ ID NO: | Antisense strand sequence (5'--->3') | SEQ ID NO: | Target APCS mRNA sequence | APCS relative expression level |
|---|---|---|---|---|---|---|---|
| AH0096 | SEQ ID NO: 97 | CAGCCUCCUGGAAGCCUUUGC | SEQ ID NO: 740 | AAAGGCUUCCAGGAGGCUGGU | SEQ ID NO: 1383 | CAGCCUCCUGGAAGCCUUUU | 0.066 |
| AH0097 | SEQ ID NO: 98 | AGCCUCCUGGAAGCCUUUGCU | SEQ ID NO: 741 | CAAAGGCUUCCAGGAGGCUGG | SEQ ID NO: 1384 | AGCCUCCUGGAAGCCUUUUG | 0.486 |
| AH0098 | SEQ ID NO: 99 | GCCUCCUGGAAGCCUUUGCUC | SEQ ID NO: 742 | GCAAAGGCUUCCAGGAGGCUG | SEQ ID NO: 1385 | GCCUCCUGGAAGCCUUUUGC | 0.374 |
| AH0099 | SEQ ID NO: 100 | CCUCCUGGAAGCCUUUGCUCA | SEQ ID NO: 743 | AGCAAAGGCUUCCAGGAGGCU | SEQ ID NO: 1386 | CCUCCUGGAAGCCUUUUGCU | 0.111 |
| AH0100 | SEQ ID NO: 101 | CUCCUGGAAGCCUUUGCUCAC | SEQ ID NO: 744 | GAGCAAAGGCUUCCAGGAGGC | SEQ ID NO: 1387 | CUCCUGGAAGCCUUUUGCUC | 0.310 |
| AH0101 | SEQ ID NO: 102 | UCCUGGAAGCCUUUGCUCACA | SEQ ID NO: 745 | UGAGCAAAGGCUUCCAGGAGG | SEQ ID NO: 1388 | UCCUGGAAGCCUUUUGCUCA | 0.053 |
| AH0102 | SEQ ID NO: 103 | CCUGGAAGCCUUUGCUCACAC | SEQ ID NO: 746 | GUGAGCAAAGGCUUCCAGGAG | SEQ ID NO: 1389 | CCUGGAAGCCUUUUGCUCAC | 0.086 |
| AH0103 | SEQ ID NO: 104 | CUGGAAGCCUUUGCUCACACA | SEQ ID NO: 747 | UGUGAGCAAAGGCUUCCAGGA | SEQ ID NO: 1390 | CUGGAAGCCUUUUGCUCACA | 0.121 |
| AH0104 | SEQ ID NO: 105 | GGAAGCCUUUGCUCACACAGA | SEQ ID NO: 748 | UCUGUGAGCAAAGGCUUCCAG | SEQ ID NO: 1391 | GGAAGCCUUUUGCUCACACA | 0.161 |
| AH0105 | SEQ ID NO: 106 | GAAGCCUUUGCUCACACAGAC | SEQ ID NO: 749 | GUCUGUGAGCAAAGGCUUCCA | SEQ ID NO: 1392 | GAAGCCUUUUGCUCACACAG | 0.291 |
| AH0106 | SEQ ID NO: 107 | AAGCCUUUGCUCACACAGACC | SEQ ID NO: 750 | GGUCUGUGAGCAAAGGCUUCC | SEQ ID NO: 1393 | AAGCCUUUUGCUCACACAGA | 0.065 |
| AH0107 | SEQ ID NO: 108 | AGCCUUUGCUCACACAGACCU | SEQ ID NO: 751 | AGGUCUGUGAGCAAAGGCUUC | SEQ ID NO: 1394 | AGCCUUUUGCUCACACAGAC | 0.136 |
| AH0108 | SEQ ID NO: 109 | GCCUUUGCUCACACAGACCUC | SEQ ID NO: 752 | GAGGUCUGUGAGCAAAGGCUU | SEQ ID NO: 1395 | GCCUUUUGCUCACACAGACC | 0.094 |
| AH0109 | SEQ ID NO: 110 | CCUUUGCUCACACAGACCUCA | SEQ ID NO: 753 | UGAGGUCUGUGAGCAAAGGCU | SEQ ID NO: 1396 | CCUUUGCUCACACAGACCU | 0.107 |
| AH0110 | SEQ ID NO: 111 | CUUUGCUCACACAGACCUCAG | SEQ ID NO: 754 | CUGAGGUCUGUGAGCAAAGGC | SEQ ID NO: 1397 | CUUUGCUCACACAGACCUC | 0.254 |
| AH0111 | SEQ ID NO: 112 | UUUGCUCACACAGACCUCAGU | SEQ ID NO: 755 | ACUGAGGUCUGUGAGCAAAGG | SEQ ID NO: 1398 | UUUGCUCACACAGACCUCA | 0.334 |
| AH0112 | SEQ ID NO: 113 | UGCUCACACAGACCUCAGUGG | SEQ ID NO: 756 | CCACUGAGGUCUGUGAGCAA | SEQ ID NO: 1399 | UGCUCACACAGACCUCAGU | 0.302 |
| AH0113 | SEQ ID NO: 114 | CUCACACAGACCUCAGUGGGA | SEQ ID NO: 757 | UCCCACUGAGGUCUGUGAGCA | SEQ ID NO: 1400 | CUCACACAGACCUCAGUGG | 0.490 |
| AH0114 | SEQ ID NO: 115 | CACACAGACCUCAGUGGGAAG | SEQ ID NO: 758 | CUUCCCACUGAGGUCUGUGAG | SEQ ID NO: 1401 | CACACAGACCUCAGUGGGA | 0.109 |
| AH0115 | SEQ ID NO: 116 | ACACAGACCUCAGUGGGAAGG | SEQ ID NO: 759 | CCUUCCCACUGAGGUCUGUGA | SEQ ID NO: 1402 | ACACAGACCUCAGUGGGAA | 0.105 |
| AH0116 | SEQ ID NO: 117 | CACAGACCUCAGUGGGAAGGA | SEQ ID NO: 760 | UCCUUCCCACUGAGGUCUGUG | SEQ ID NO: 1403 | CACAGACCUCAGUGGGAAG | 0.478 |
| AH0117 | SEQ ID NO: 118 | AGACCUCAGUGGGAAGGAAGG | SEQ ID NO: 761 | CCUUCCUUCCCACUGAGGUCU | SEQ ID NO: 1404 | AGACCUCAGUGGGAAGGUG | 0.157 |
| AH0118 | SEQ ID NO: 119 | GACCUCAGUGGGAAGGAAGGU | SEQ ID NO: 762 | ACCUUCCUUCCCACUGAGGUC | SEQ ID NO: 1405 | GACCUCAGUGGGAAGGUGU | 0.149 |
| AH0119 | SEQ ID NO: 120 | ACCUCAGUGGGAAGGAAGGUU | SEQ ID NO: 763 | AACACCUUCCUUCCCACUGAGGUCU | SEQ ID NO: 1406 | ACCUCAGUGGGAAGGUGUU | 0.123 |

TABLE 1-continued

| Double stranded nucleic acid No. | Sense strand sequence (5'--->3') | SEQ ID NO: | Antisense strand sequence (5'--->3') | SEQ ID NO: | Target APCS mRNA sequence | APCS relative expression level |
|---|---|---|---|---|---|---|
| AH0120 | CCUCAGUGGGAAGGUGUUUGU | SEQ ID NO: 121 | AAACACCUUCCCACUGAGGUC | SEQ ID NO: 764 | CCUCAGUGGGAAGGUGUUU | 0.261 |
| AH0121 | CUCAGUGGGAAGGUGUUUGUA | SEQ ID NO: 122 | CAAACACCUUCCCACUGAGGU | SEQ ID NO: 765 | CUCAGUGGGAAGGUGUUUG | 0.316 |
| AH0122 | UCAGUGGGAAGGUGUUUGUAU | SEQ ID NO: 123 | ACAAACACCUUCCCACUGAGG | SEQ ID NO: 766 | UCAGUGGGAAGGUGUUUGU | 0.125 |
| AH0123 | CAGUGGGAAGGUGUUUGUAUU | SEQ ID NO: 124 | UACAAACACCUUCCCACUGAG | SEQ ID NO: 767 | CAGUGGGAAGGUGUUUGUA | 0.185 |
| AH0124 | AGUGGGAAGGUGUUUGUAUUU | SEQ ID NO: 125 | AUACAAACACCUUCCCACUGA | SEQ ID NO: 768 | AGUGGGAAGGUGUUUGUAU | 0.105 |
| AH0125 | GUGGGAAGGUGUUUGUAUUUC | SEQ ID NO: 126 | AAUACAAACACCUUCCCACUG | SEQ ID NO: 769 | GUGGGAAGGUGUUUGUAUU | 0.101 |
| AH0126 | UGGGAAGGUGUUUGUAUUUCC | SEQ ID NO: 127 | AAAUACAAACACCUUCCCACU | SEQ ID NO: 770 | UGGGAAGGUGUUUGUAUUU | 0.150 |
| AH0127 | GGGAAGGUGUUUGUAUUUCCU | SEQ ID NO: 128 | GAAAUACAAACACCUUCCCAC | SEQ ID NO: 771 | GGGAAGGUGUUUGUAUUUC | 0.386 |
| AH0128 | GGAAGGUGUUUGUAUUUCCUA | SEQ ID NO: 129 | GGAAAUACAAACACCUUCCCA | SEQ ID NO: 772 | GGAAGGUGUUUGUAUUUCC | 0.127 |
| AH0129 | GAAGGUGUUUGUAUUUCCUAG | SEQ ID NO: 130 | AGGAAAUACAAACACCUUCCC | SEQ ID NO: 773 | GAAGGUGUUUGUAUUUCCU | 0.077 |
| AH0130 | AAGGUGUUUGUAUUUCCUAGA | SEQ ID NO: 131 | UAGGAAAUACAAACACCUUCC | SEQ ID NO: 774 | AAGGUGUUUGUAUUUCCUA | 0.213 |
| AH0131 | AGGUGUUUGUAUUUCCUAGAG | SEQ ID NO: 132 | CUAGGAAAUACAAACACCUUC | SEQ ID NO: 775 | AGGUGUUUGUAUUUCCUAG | 0.084 |
| AH0132 | GGUGUUUGUAUUUCCUAGAGA | SEQ ID NO: 133 | UCUAGGAAAUACAAACACCUU | SEQ ID NO: 776 | GGUGUUUGUAUUUCCUAGA | 0.112 |
| AH0133 | GUGUUUGUAUUUCCUAGAGAA | SEQ ID NO: 134 | CUCUAGGAAAUACAAACACCU | SEQ ID NO: 777 | GUGUUUGUAUUUCCUAGAG | 0.153 |
| AH0134 | UGUUUGUAUUUCCUAGAGAAU | SEQ ID NO: 135 | UCUCUAGGAAAUACAAACACC | SEQ ID NO: 778 | UGUUUGUAUUUCCUAGAGA | 0.139 |
| AH0135 | GUUUGUAUUUCCUAGAGAAUC | SEQ ID NO: 136 | UUCUCUAGGAAAUACAAACAC | SEQ ID NO: 779 | GUUUGUAUUUCCUAGAGAA | 0.070 |
| AH0136 | UUUGUAUUUCCUAGAGAAUCU | SEQ ID NO: 137 | AUUCUCUAGGAAAUACAAACA | SEQ ID NO: 780 | UUUGUAUUUCCUAGAGAAU | 0.125 |
| AH0137 | UUGUAUUUCCUAGAGAAUCUG | SEQ ID NO: 138 | GAUUCUCUAGGAAAUACAAAC | SEQ ID NO: 781 | UUGUAUUUCCUAGAGAAUC | 0.451 |
| AH0138 | UGUAUUUCCUAGAGAAUCUGU | SEQ ID NO: 139 | AGAUUCUCUAGGAAAUACAAA | SEQ ID NO: 782 | UGUAUUUCCUAGAGAAUCU | 0.204 |
| AH0139 | GUAUUUCCUAGAGAAUCUGUU | SEQ ID NO: 140 | CAGAUUCUCUAGGAAAUACAA | SEQ ID NO: 783 | GUAUUUCCUAGAGAAUCUG | 0.071 |
| AH0140 | UAUUUCCUAGAGAAUCUGUUA | SEQ ID NO: 141 | ACAGAUUCUCUAGGAAAUACA | SEQ ID NO: 784 | UAUUUCCUAGAGAAUCUGU | 0.242 |
| AH0141 | AUUUCCUAGAGAAUCUGUUAC | SEQ ID NO: 142 | AACAGAUUCUCUAGGAAAUAC | SEQ ID NO: 785 | AUUUCCUAGAGAAUCUGUU | 0.123 |
| AH0142 | UUUCCUAGAGAAUCUGUUACU | SEQ ID NO: 143 | UAACAGAUUCUCUAGGAAAUA | SEQ ID NO: 786 | UUUCCUAGAGAAUCUGUUA | 0.179 |
| AH0143 | UUCCUAGAGAAUCUGUUACUA | SEQ ID NO: 144 | AGUAACAGAUUCUCUAGGAAA | SEQ ID NO: 787 | UCCUAGAGAAUCUGUUACU | 0.311 |

TABLE 1-continued

| Double stranded nucleic acid No. | SEQ ID NO: | Sense strand sequence (5'--->3') | SEQ ID NO: | Antisense strand sequence (5'--->3') | SEQ ID NO: | Target APCS mRNA sequence | APCS relative expression level |
|---|---|---|---|---|---|---|---|
| AH0144 | SEQ ID NO: 145 | CCUAGAGAAUCUGUUACUGAU | SEQ ID NO: 788 | CAGUAACAGAUUCUCUAGGAA | SEQ ID NO: 1431 | CCUAGAGAAUCUGUUACUG | 0.137 |
| AH0145 | SEQ ID NO: 146 | CUAGAGAAUCUGUUACUGAUC | SEQ ID NO: 789 | UCAGUAACAGAUUCUCUAGGA | SEQ ID NO: 1432 | CUAGAGAAUCUGUUACUGA | 0.039 |
| AH0146 | SEQ ID NO: 147 | UAGAGAAUCUGUUACUGAUCA | SEQ ID NO: 790 | AUCAGUAACAGAUUCUCUAGG | SEQ ID NO: 1433 | UAGAGAAUCUGUUACUGAU | 0.051 |
| AH0147 | SEQ ID NO: 148 | AGAGAAUCUGUUACUGAUCAU | SEQ ID NO: 791 | GAUCAGUAACAGAUUCUCUAG | SEQ ID NO: 1434 | AGAGAAUCUGUUACUGAUC | 0.361 |
| AH0148 | SEQ ID NO: 149 | GAGAAUCUGUUACUGAUCAUG | SEQ ID NO: 792 | UGAUCAGUAACAGAUUCUCUA | SEQ ID NO: 1435 | GAGAAUCUGUUACUGAUCA | 0.090 |
| AH0149 | SEQ ID NO: 150 | AGAAUCUGUUACUGAUCAUGU | SEQ ID NO: 793 | AUGAUCAGUAACAGAUUCUCU | SEQ ID NO: 1436 | AGAAUCUGUUACUGAUCAU | 0.211 |
| AH0150 | SEQ ID NO: 151 | GAAUCUGUUACUGAUCAUGUA | SEQ ID NO: 794 | CAUGAUCAGUAACAGAUUCUC | SEQ ID NO: 1437 | GAAUCUGUUACUGAUCAUG | 0.183 |
| AH0151 | SEQ ID NO: 152 | AAUCUGUUACUGAUCAUGUAA | SEQ ID NO: 795 | ACAUGAUCAGUAACAGAUUCU | SEQ ID NO: 1438 | AAUCUGUUACUGAUCAUGU | 0.477 |
| AH0152 | SEQ ID NO: 153 | AUCUGUUACUGAUCAUGUAAA | SEQ ID NO: 796 | UACAUGAUCAGUAACAGAUUC | SEQ ID NO: 1439 | AUCUGUUACUGAUCAUGUA | 0.103 |
| AH0153 | SEQ ID NO: 154 | UCUGUUACUGAUCAUGUAAAC | SEQ ID NO: 797 | UUACAUGAUCAGUAACAGAUU | SEQ ID NO: 1440 | UCUGUUACUGAUCAUGUAA | 0.166 |
| AH0154 | SEQ ID NO: 155 | CUGUUACUGAUCAUGUAAACU | SEQ ID NO: 798 | UUUACAUGAUCAGUAACAGA | SEQ ID NO: 1441 | CUGUUACUGAUCAUGUAAA | 0.155 |
| AH0155 | SEQ ID NO: 156 | UGUUACUGAUCAUGUAAACUG | SEQ ID NO: 799 | GUUUACAUGAUCAGUAACAGA | SEQ ID NO: 1442 | UGUUACUGAUCAUGUAAAC | 0.260 |
| AH0156 | SEQ ID NO: 157 | GUUACUGAUCAUGUAAACUUG | SEQ ID NO: 800 | AGUUUACAUGAUCAGUAACAG | SEQ ID NO: 1443 | GUUACUGAUCAUGUAAACU | 0.213 |
| AH0157 | SEQ ID NO: 158 | UUACUGAUCAUGUAAACUUGA | SEQ ID NO: 801 | UCAAGUUUACAUGAUCAGUAA | SEQ ID NO: 1444 | UUACUGAUCAUGUAAACUUG | 0.365 |
| AH0158 | SEQ ID NO: 159 | UACUGAUCAUGUAAACUUGAU | SEQ ID NO: 802 | AUCAAGUUUACAUGAUCAGUA | SEQ ID NO: 1445 | UACUGAUCAUGUAAACUUGA | 0.167 |
| AH0159 | SEQ ID NO: 160 | ACUGAUCAUGUAAACUUGAUC | SEQ ID NO: 803 | GAUCAAGUUUACAUGAUCAGU | SEQ ID NO: 1446 | ACUGAUCAUGUAAACUUGAU | 0.457 |
| AH0160 | SEQ ID NO: 161 | CUGAUCAUGUAAACUUGAUCA | SEQ ID NO: 804 | UGAUCAAGUUUACAUGAUCAG | SEQ ID NO: 1447 | CUGAUCAUGUAAACUUGAUC | 0.338 |
| AH0161 | SEQ ID NO: 162 | UGAUCAUGUAAACUUGAUCAC | SEQ ID NO: 805 | UGUGAUCAAGUUUACAUGAUC | SEQ ID NO: 1448 | UGAUCAUGUAAACUUGAUCA | 0.286 |
| AH0162 | SEQ ID NO: 163 | GAUCAUGUAAACUUGAUCACC | SEQ ID NO: 806 | GUGUGAUCAAGUUUACAUGAU | SEQ ID NO: 1449 | GAUCAUGUAAACUUGAUCAC | 0.485 |
| AH0163 | SEQ ID NO: 164 | AUCAUGUAAACUUGAUCACCG | SEQ ID NO: 807 | AGCGGUGAUCAAGUUUACAUGA | SEQ ID NO: 1450 | AUCAUGUAAACUUGAUCACC | 0.355 |
| AH0164 | SEQ ID NO: 165 | UCAUGUAAACUUGAUCACCGCU | SEQ ID NO: 808 | UGAUCAAGUUUACAUGAUCAGU | SEQ ID NO: 1451 | UCAUGUAAACUUGAUCACCGCU | 0.360 |
| AH0165 | SEQ ID NO: 166 | CAUGUAAACUUGAUCACCGCGA | SEQ ID NO: 809 | CAGCGGUGAUCAAGUUUACAUGA | SEQ ID NO: 1452 | CAUGUAAACUUGAUCACCGCUG | 0.212 |
| AH0166 | SEQ ID NO: 167 | AUGUAAACUUGAUCACCGCGUGGA | SEQ ID NO: 810 | UCCAGCGGUGAUCAAGUUUACAUGA | SEQ ID NO: 1453 | AUGUAAACUUGAUCACCGCUGGA | 0.493 |
| AH0167 | SEQ ID NO: 168 | UGAUCACCGCGUGGAGAGCU | SEQ ID NO: 811 | UUCUCCAGCGGUGAUCAAGU | SEQ ID NO: 1454 | UGAUCACCGCGUGGAGAA | 0.078 |

TABLE 1-continued

| Double stranded nucleic acid No. | SEQ ID NO: | Sense strand sequence (5'--->3') | SEQ ID NO: | Antisense strand sequence (5'--->3') | SEQ ID NO: | Target APCS mRNA sequence | APCS relative expression level |
|---|---|---|---|---|---|---|---|
| AH0168 | SEQ ID NO: 169 | GAUCACACCGCUGGAGAAGCC | SEQ ID NO: 812 | CUUCUCCAGCGGUGUGAUCAA | SEQ ID NO: 1455 | GAUCACACCGCUGGAGAAG | 0.465 |
| AH0169 | SEQ ID NO: 170 | CACACCGCUGGAGAAGCCUCU | SEQ ID NO: 813 | AGGGCUUCUCCAGCGGUGUGAU | SEQ ID NO: 1456 | CACACCGCUGGAGAAGCCU | 0.312 |
| AH0170 | SEQ ID NO: 171 | ACACCGCUGGAGAAGCCUCUA | SEQ ID NO: 814 | GAGGCUUCUCCAGCGGUGUGA | SEQ ID NO: 1457 | ACACCGCUGGAGAAGCCUC | 0.208 |
| AH0171 | SEQ ID NO: 172 | CACCGCUGGAGAAGCCUCUAC | SEQ ID NO: 815 | AGAGGCUUCUCCAGCGGUGUG | SEQ ID NO: 1458 | CACCGCUGGAGAAGCCUCU | 0.190 |
| AH0172 | SEQ ID NO: 173 | ACCGCUGGAGAAGCCUCUACA | SEQ ID NO: 816 | UAGAGGCUUCUCCAGCGGUGU | SEQ ID NO: 1459 | ACCGCUGGAGAAGCCUCUA | 0.276 |
| AH0173 | SEQ ID NO: 174 | CCGCUGGAGAAGCCUCUACAG | SEQ ID NO: 817 | GUAGAGGCUUCUCCAGCGGUG | SEQ ID NO: 1460 | CCGCUGGAGAAGCCUCUAC | 0.397 |
| AH0174 | SEQ ID NO: 175 | CGCUGGAGAAGCCUCUACAGA | SEQ ID NO: 818 | UGUAGAGGCUUCUCCAGCGGU | SEQ ID NO: 1461 | CGCUGGAGAAGCCUCUACA | 0.056 |
| AH0175 | SEQ ID NO: 176 | GCUGGAGAAGCCUCUACAGAA | SEQ ID NO: 819 | CUGUAGAGGCUUCUCCAGCGG | SEQ ID NO: 1462 | GCUGGAGAAGCCUCUACAG | 0.335 |
| AH0176 | SEQ ID NO: 177 | CUGGAGAAGCCUCUACAGAAC | SEQ ID NO: 820 | UCUGUAGAGGCUUCUCCAGCG | SEQ ID NO: 1463 | CUGGAGAAGCCUCUACAGA | 0.080 |
| AH0177 | SEQ ID NO: 178 | UGGAGAAGCCUCUACAGAACU | SEQ ID NO: 821 | UUCUGUAGAGGCUUCUCCAGC | SEQ ID NO: 1464 | UGGAGAAGCCUCUACAGAA | 0.088 |
| AH0178 | SEQ ID NO: 179 | GGAGAAGCCUCUACAGAACUU | SEQ ID NO: 822 | GUUCUGUAGAGGCUUCUCCAG | SEQ ID NO: 1465 | GGAGAAGCCUCUACAGAAC | 0.142 |
| AH0179 | SEQ ID NO: 180 | GAGAAGCCUCUACAGAACUUA | SEQ ID NO: 823 | AGUUCUGUAGAGGCUUCUCCA | SEQ ID NO: 1466 | GAGAAGCCUCUACAGAACU | 0.276 |
| AH0180 | SEQ ID NO: 181 | AGAAGCCUCUACAGAACUUUA | SEQ ID NO: 824 | AAGUUCUGUAGAGGCUUCUCC | SEQ ID NO: 1467 | AGAAGCCUCUACAGAACUU | 0.160 |
| AH0181 | SEQ ID NO: 182 | GAAGCCUCUACAGAACUUUAC | SEQ ID NO: 825 | AAAGUUCUGUAGAGGCUUCUC | SEQ ID NO: 1468 | GAAGCCUCUACAGAACUUU | 0.156 |
| AH0182 | SEQ ID NO: 183 | AAGCCUCUACAGAACUUUACC | SEQ ID NO: 826 | UAAAGUUCUGUAGAGGCUUCU | SEQ ID NO: 1469 | AAGCCUCUACAGAACUUUA | 0.210 |
| AH0183 | SEQ ID NO: 184 | AGCCUCUACAGAACUUUACCU | SEQ ID NO: 827 | GUAAAGUUCUGUAGAGGCUUC | SEQ ID NO: 1470 | AGCCUCUACAGAACUUUAC | 0.305 |
| AH0184 | SEQ ID NO: 185 | GCCUCUACAGAACUUUACCUU | SEQ ID NO: 828 | GGUAAAGUUCUGUAGAGGCUU | SEQ ID NO: 1471 | GCCUCUACAGAACUUUACC | 0.343 |
| AH0185 | SEQ ID NO: 186 | CCUCUACAGAACUUUACCUUG | SEQ ID NO: 829 | AGGUAAAGUUCUGUAGAGGCU | SEQ ID NO: 1472 | CCUCUACAGAACUUUACCU | 0.178 |
| AH0186 | SEQ ID NO: 187 | CUCUACAGAACUUUACCUUGU | SEQ ID NO: 830 | AAGGUAAAGUUCUGUAGAGGC | SEQ ID NO: 1473 | CUCUACAGAACUUUACCUU | 0.183 |
| AH0187 | SEQ ID NO: 188 | UCUACAGAACUUUACCUUGUG | SEQ ID NO: 831 | CAAGGUAAAGUUCUGUAGAGG | SEQ ID NO: 1474 | UCUACAGAACUUUACCUUG | 0.244 |
| AH0188 | SEQ ID NO: 189 | CUACAGAACUUUACCUUGUGU | SEQ ID NO: 832 | ACAAGGUAAAGUUCUGUAGAG | SEQ ID NO: 1475 | CUACAGAACUUUACCUUGU | 0.079 |
| AH0189 | SEQ ID NO: 190 | UACAGAACUUUACCUUGUGUG | SEQ ID NO: 833 | CACAAGGUAAAGUUCUGUAGA | SEQ ID NO: 1476 | UACAGAACUUUACCUUGUG | 0.219 |
| AH0190 | SEQ ID NO: 191 | ACAGAACUUUACCUUGUGUGU | SEQ ID NO: 834 | ACACAAGGUAAAGUUCUGUAG | SEQ ID NO: 1477 | ACAGAACUUUACCUUGUGU | 0.387 |
| AH0191 | SEQ ID NO: 192 | CAGAACUUUACCUUGUGUGUU | SEQ ID NO: 835 | AACACAAGGUAAAGUUCUGUA | SEQ ID NO: 1478 | CAGAACUUUACCUUGUGUU | 0.171 |

TABLE 1-continued

| Double stranded nucleic acid No. | Sense strand sequence (5'--->3') | SEQ ID NO: | Antisense strand sequence (5'--->3') | SEQ ID NO: | Target APCS mRNA sequence | SEQ ID NO: | APCS relative expression level |
|---|---|---|---|---|---|---|---|
| AH0192 | AGAACUUUACCUUGUGUUUC | 193 | AAACACAAGGUAAAGUUCUGU | 836 | AGAACUUUACCUUGUGUUU | 1479 | 0.133 |
| AH0193 | GAACUUUACCUUGUGUUUCG | 194 | AAAACACAAGGUAAAGUUCUG | 837 | GAACUUUACCUUGUGUUUU | 1480 | 0.081 |
| AH0194 | AACUUUACCUUGUGUUUUCC | 195 | GAAAACACAAGGUAAAGUUCU | 838 | AACUUUACCUUGUGUUUUC | 1481 | 0.347 |
| AH0195 | CUUUACCUUGUGUUUUCGAGC | 196 | UCGAAAACACAAGGUAAAGUU | 839 | CUUUACCUUGUGUUUUCGA | 1482 | 0.453 |
| AH0196 | ACCUUGUGUUUUCGAGCCUAU | 197 | AGGCUCGAAAACACAAGGUAA | 840 | ACCUUGUGUUUUCGAGCCU | 1483 | 0.164 |
| AH0197 | CCUUGUGUUUUCGAGCCUAUA | 198 | UAGGCUCGAAAACACAAGGUA | 841 | CCUUGUGUUUUCGAGCCUA | 1484 | 0.081 |
| AH0198 | CUUGUGUUUUCGAGCCUAUAG | 199 | AUAGGCUCGAAAACACAAGGU | 842 | CUUGUGUUUUCGAGCCUAU | 1485 | 0.110 |
| AH0199 | UUGUGUUUUCGAGCCUAUAGU | 200 | UAUAGGCUCGAAAACACAAGG | 843 | UUGUGUUUUCGAGCCUAUA | 1486 | 0.137 |
| AH0200 | GUGUGUUUUCGAGCCUAUAGUGA | 201 | ACUAUAGGCUCGAAAACACAA | 844 | GUGUGUUUUCGAGCCUAUAGU | 1487 | 0.125 |
| AH0201 | GUUUUCGAGCCUAUAGUGAUC | 202 | UCACUAUAGGCUCGAAAACAC | 845 | GUUUUCGAGCCUAUAGUGA | 1488 | 0.074 |
| AH0202 | UUUUCGAGCCUAUAGUGAUCU | 203 | AUCACUAUAGGCUCGAAAACA | 846 | UUUUCGAGCCUAUAGUGAU | 1489 | 0.136 |
| AH0203 | CGAGCCUAUAGUGAUCUCUCU | 204 | AGAGAUCACUAUAGGCUCGAA | 847 | CGAGCCUAUAGUGAUCUCU | 1490 | 0.119 |
| AH0204 | GAGCCUAUAGUGAUCUCUCUC | 205 | GAGAGAUCACUAUAGGCUCGA | 848 | GAGCCUAUAGUGAUCUCUC | 1491 | 0.127 |
| AH0205 | AGCCUAUAGUGAUCUCUCUCG | 206 | AGAGAGAUCACUAUAGGCUCG | 849 | AGCCUAUAGUGAUCUCUCU | 1492 | 0.091 |
| AH0206 | CCUAUAGUGAUCUCUCUCGUG | 207 | GAGAGAGAUCACUAUAGGCUC | 850 | GCCUAUAGUGAUCUCUCUC | 1493 | 0.090 |
| AH0207 | CUAUAGUGAUCUCUCUCGUGG | 208 | CGAGAGAGAUCACUAUAGGCU | 851 | CCUAUAGUGAUCUCUCUCG | 1494 | 0.287 |
| AH0208 | UAUAGUGAUCUCUCUCGUGGC | 209 | ACGAGAGAGAUCACUAUAGGC | 852 | CUAUAGUGAUCUCUCUCGU | 1495 | 0.088 |
| AH0209 | AGUGAUCUCUCUCGUGGCC | 210 | CACGAGAGAGAUCACUAUAGG | 853 | UAUAGUGAUCUCUCUCGUG | 1496 | 0.355 |
| AH0210 | AGUGAUCUCUCUCGUGGCCUAC | 211 | AGGCCACGAGAGAGAUCACUAU | 854 | AGUGAUCUCUCUCGUGCCU | 1497 | 0.089 |
| AH0211 | GUGAUCUCUCUCGUGCCUACA | 212 | UAGGCCACGAGAGAGAUCACUA | 855 | GUGAUCUCUCUCGUGCCUA | 1498 | 0.072 |
| AH0212 | UGAUCUCUCUCGUGCCUACAG | 213 | GUAGGCCACGAGAGAGAUCACU | 856 | UGAUCUCUCUCGUGCCUAC | 1499 | 0.158 |
| AH0213 | GAUCUCUCUCGUGCCUACAGC | 214 | UGUAGGCCACGAGAGAGAUCAC | 857 | GAUCUCUCUCGUGCCUACA | 1500 | 0.126 |
| AH0214 | CUCUCUCGUGCCUACAGCCUCU | 215 | GAGGCUGUAGGCACGAGAGAG | 858 | CUCUCUCGUGCCUACAGCC | 1501 | 0.196 |
| AH0215 | UCUCGUGCCUACAGCCUCUUC | 216 | AGAGGCUGUAGGCACGAGAGA | 859 | UCUCGUGCCUACAGCCUCU | 1502 | 0.140 |

TABLE 1-continued

| Double stranded nucleic acid No. | Sense strand sequence (5'--->3') | SEQ ID NO: | Antisense strand sequence (5'--->3') | SEQ ID NO: | Target APCS mRNA sequence | SEQ ID NO: | APCS relative expression level |
|---|---|---|---|---|---|---|---|
| AH0216 | CUCGUGCCUACAGCCUCUCU | SEQ ID NO: 217 | AAGAGGCUGUAGGCACGAGAG | SEQ ID NO: 860 | CUCGUGCCUACAGCCCUCUU | SEQ ID NO: 1503 | 0.198 |
| AH0217 | CGUGCCUACAGCCUCUUCCC | SEQ ID NO: 218 | AGAAGAGGCUGUAGGCACGAG | SEQ ID NO: 861 | CGUGCCUACAGCCUCUUCUCU | SEQ ID NO: 1504 | 0.181 |
| AH0218 | GUGCCUACAGCCUCUUCUCCU | SEQ ID NO: 219 | GAGAAGAGGCUGUAGGCACGA | SEQ ID NO: 862 | GUGCCUACAGCCUCUUCUCUC | SEQ ID NO: 1505 | 0.101 |
| AH0219 | GCCUACAGCCUCUUCUCCUAC | SEQ ID NO: 220 | AGGAGAAGAGGCUGUAGGCAC | SEQ ID NO: 863 | GCCUACAGCCUCUUCUCUCCU | SEQ ID NO: 1506 | 0.100 |
| AH0220 | CCUACAGCCUCUUCUCCUACA | SEQ ID NO: 221 | UAGGAGAAGAGGCUGUAGGCA | SEQ ID NO: 864 | CCUACAGCCUCUUCUCUCCUA | SEQ ID NO: 1507 | 0.086 |
| AH0221 | CUACAGCCUCUUCUCCUACAA | SEQ ID NO: 222 | GUAGGAGAAGAGGCUGUAGGC | SEQ ID NO: 865 | CUACAGCCUCUUCUCUCCUAC | SEQ ID NO: 1508 | 0.153 |
| AH0222 | UACAGCCUCUUCUCCUACAAU | SEQ ID NO: 223 | UGUAGGAGAAGAGGCUGUAGG | SEQ ID NO: 866 | UACAGCCUCUUCUCCUACA | SEQ ID NO: 1509 | 0.221 |
| AH0223 | ACAGCCUCUUCUCCUACAAUA | SEQ ID NO: 224 | UUGUAGGAGAAGAGGCUGUAG | SEQ ID NO: 867 | ACAGCCCUCUUCUCCUACAA | SEQ ID NO: 1510 | 0.137 |
| AH0224 | CAGCCUCUUCUCCUACAAUAC | SEQ ID NO: 225 | AUUGUAGGAGAAGAGGCUGUA | SEQ ID NO: 868 | CAGCCUCUUCUCCUACAAU | SEQ ID NO: 1511 | 0.184 |
| AH0225 | AGCCUCUUCUCCUACAAUACC | SEQ ID NO: 226 | UAUUGUAGGAGAAGAGGCUGU | SEQ ID NO: 869 | AGCCUCUUCUCCUACAAUA | SEQ ID NO: 1512 | 0.036 |
| AH0226 | GCCUCUUCUCCUACAAUACCC | SEQ ID NO: 227 | GUAUUGUAGGAGAAGAGGCUG | SEQ ID NO: 870 | GCCUCUUCUCCUACAAUAC | SEQ ID NO: 1513 | 0.172 |
| AH0227 | CCUCUUCUCCUACAAUACCCA | SEQ ID NO: 228 | GGUAUUGUAGGAGAAGAGGCU | SEQ ID NO: 871 | CCUUCUUCUCCUACAAUACC | SEQ ID NO: 1514 | 0.116 |
| AH0228 | UCUUCUCCUACAAUACCCAAG | SEQ ID NO: 229 | UGGGUAUUGUAGGAGAAGAGG | SEQ ID NO: 872 | UCUUCUCCUACAAUACCCA | SEQ ID NO: 1515 | 0.450 |
| AH0229 | UCUCCUACAAUACCCAAGGCA | SEQ ID NO: 230 | CCUUGGGUAUUGUAGGAGAAG | SEQ ID NO: 873 | UCUCCUACAAUACCCAAGG | SEQ ID NO: 1516 | 0.486 |
| AH0230 | CUCCUACAAUACCCAAGGCAG | SEQ ID NO: 231 | GCCUUGGGUAUUGUAGGAGAA | SEQ ID NO: 874 | CUCCUACAAUACCCAAGGC | SEQ ID NO: 1517 | 0.303 |
| AH0231 | UCCUACAAUACCCAAGGCAGG | SEQ ID NO: 232 | UGCCUUGGGUAUUGUAGGAGA | SEQ ID NO: 875 | UCCUACAAUACCCAAGGCA | SEQ ID NO: 1518 | 0.206 |
| AH0232 | CCUACAAUACCCAAGGCAGGG | SEQ ID NO: 233 | CUGCCUUGGGUAUUGUAGGAG | SEQ ID NO: 876 | CCUACAAUACCCAAGGCAG | SEQ ID NO: 1519 | 0.324 |
| AH0233 | CUACAAUACCCAAGGCAGGGA | SEQ ID NO: 234 | CCUGCCUUGGGUAUUGUAGGA | SEQ ID NO: 877 | CUACAAUACCCAAGGCAGG | SEQ ID NO: 1520 | 0.223 |
| AH0234 | CAAUACCCAAGGCAGGGAUAU | SEQ ID NO: 235 | AUCCCUGCCUUGGGUAUUGUA | SEQ ID NO: 878 | CAAUACCCAAGGCAGGGAU | SEQ ID NO: 1521 | 0.323 |
| AH0235 | AUACCCAAGGCAGGGAUAUAUG | SEQ ID NO: 236 | UUAUCCCUGCCUUGGGUAUUG | SEQ ID NO: 879 | AUACCCAAGGCAGGGAUAA | SEQ ID NO: 1522 | 0.207 |
| AH0236 | UACCCAAGGCAGGGAUAUAUGA | SEQ ID NO: 237 | AUUAUCCCUGCCUUGGGUAUU | SEQ ID NO: 880 | UACCCAAGGCAGGGAUAUAU | SEQ ID NO: 1523 | 0.450 |
| AH0237 | CCAAGGCAGGGAUAUAUGAGCU | SEQ ID NO: 238 | CUCAUAUAUCCCUGCCUUGGGU | SEQ ID NO: 881 | CCAAGGCAGGGAUAAUGAG | SEQ ID NO: 1524 | 0.424 |
| AH0238 | AAGGCAGGGAUAUAUGAGCUAC | SEQ ID NO: 239 | AGCUCAUAUAUCCCUGCCUUGG | SEQ ID NO: 882 | AAGGCAGGGAUAUAAUGAGCU | SEQ ID NO: 1525 | 0.172 |
| AH0239 | AGGCAGGGAUAUAUGAGCUACU | SEQ ID NO: 240 | UAGCUCAUAUAUCCCUGCCUUG | SEQ ID NO: 883 | AGGCAGGGAUAUAUGAGCUA | SEQ ID NO: 1526 | 0.396 |

TABLE 1-continued

| Double stranded nucleic acid No. | SEQ ID NO: | Sense strand sequence (5'--->3') | SEQ ID NO: | Antisense strand sequence (5'--->3') | SEQ ID NO: | Target APCS mRNA sequence | APCS relative expression level |
|---|---|---|---|---|---|---|---|
| AH0240 | SEQ ID NO: 241 | GCAGGGAUAAUGAGCUACUAG | SEQ ID NO: 884 | AGUAGCUCAUUAUCCCUGCCU | SEQ ID NO: 1527 | GCAGGGAUAAUGAGCUACU | 0.280 |
| AH0241 | SEQ ID NO: 242 | CAGGGAUAAUGAGCUACUAGU | SEQ ID NO: 885 | UAGUAGCUCAUUAUCCCUGCC | SEQ ID NO: 1528 | CAGGGAUAAUGAGCUACUA | 0.143 |
| AH0242 | SEQ ID NO: 243 | AGGGAUAAUGAGCUACUAGUU | SEQ ID NO: 886 | CUAGUAGCUCAUUAUCCCUGC | SEQ ID NO: 1529 | AGGGAUAAUGAGCUACUAG | 0.325 |
| AH0243 | SEQ ID NO: 244 | GGGAUAAUGAGCUACUAGUUU | SEQ ID NO: 887 | ACUAGUAGCUCAUUAUCCCUG | SEQ ID NO: 1530 | GGGAUAAUGAGCUACUAGU | 0.085 |
| AH0244 | SEQ ID NO: 245 | GGAUAAUGAGCUACUAGUUUA | SEQ ID NO: 888 | AACUAGUAGCUCAUUAUCCCU | SEQ ID NO: 1531 | GGAUAAUGAGCUACUAGUU | 0.073 |
| AH0245 | SEQ ID NO: 246 | GAUAAUGAGCUACUAGUUUAU | SEQ ID NO: 889 | AAACUAGUAGCUCAUUAUCCC | SEQ ID NO: 1532 | GAUAAUGAGCUACUAGUUU | 0.085 |
| AH0246 | SEQ ID NO: 247 | AUAAUGAGCUACUAGUUUAUA | SEQ ID NO: 890 | UAAACUAGUAGCUCAUUAUCC | SEQ ID NO: 1533 | AUAAUGAGCUACUAGUUUA | 0.115 |
| AH0247 | SEQ ID NO: 248 | UAAUGAGCUACUAGUUUAUAA | SEQ ID NO: 891 | AUAAACUAGUAGCUCAUUAUC | SEQ ID NO: 1534 | UAAUGAGCUACUAGUUUAU | 0.115 |
| AH0248 | SEQ ID NO: 249 | AAUGAGCUACUAGUUUAUAAA | SEQ ID NO: 892 | UUAUAAACUAGUAGCUCAUUA | SEQ ID NO: 1535 | AAUGAGCUACUAGUUUAUA | 0.195 |
| AH0249 | SEQ ID NO: 250 | UGAGCUACUAGUUUAUAAAGA | SEQ ID NO: 893 | UUUAUAAACUAGUAGCUCAUU | SEQ ID NO: 1536 | UGAGCUACUAGUUUAUAAA | 0.124 |
| AH0250 | SEQ ID NO: 251 | GAGCUACUAGUUUAUAAAGAA | SEQ ID NO: 894 | CUUUAUAAACUAGUAGCUCAU | SEQ ID NO: 1537 | GAGCUACUAGUUUAUAAAG | 0.449 |
| AH0251 | SEQ ID NO: 252 | AGCUACUAGUUUAUAAAGAAA | SEQ ID NO: 895 | UCUUUAUAAACUAGUAGCUCA | SEQ ID NO: 1538 | AGCUACUAGUUUAUAAAGA | 0.131 |
| AH0252 | SEQ ID NO: 253 | GCUACUAGUUUAUAAAGAAAG | SEQ ID NO: 896 | UUCUUUAUAAACUAGUAGCUC | SEQ ID NO: 1539 | GCUACUAGUUUAUAAAGAA | 0.092 |
| AH0253 | SEQ ID NO: 254 | CUACUAGUUUAUAAAGAAAGA | SEQ ID NO: 897 | UUUCUUUAUAAACUAGUAGCU | SEQ ID NO: 1540 | CUACUAGUUUAUAAAGAAA | 0.091 |
| AH0254 | SEQ ID NO: 255 | AGUUUAUAAAGAAAGAGUUGG | SEQ ID NO: 898 | AACUCUUUCUUUAUAAACUAG | SEQ ID NO: 1541 | AGUUUAUAAAGAAAGAGUU | 0.327 |
| AH0255 | SEQ ID NO: 256 | AGCUACUAGUUGGAGUAUA | SEQ ID NO: 899 | UACUCCAACUCUUUCUUUA | SEQ ID NO: 1542 | AAGAAAGAGUUGGAGAGUA | 0.114 |
| AH0256 | SEQ ID NO: 257 | AGAAAGAGUUGGAGAGUAUAG | SEQ ID NO: 900 | AUACUCUCCAACUCUUUCUUU | SEQ ID NO: 1543 | AGAAAGAGUUGGAGAGUAU | 0.142 |
| AH0257 | SEQ ID NO: 258 | GAAAGAGUUGGAGAGUAUAGU | SEQ ID NO: 901 | UAUACUCUCCAACUCUUUCUU | SEQ ID NO: 1544 | GAAAGAGUUGGAGAGUAUA | 0.089 |
| AH0258 | SEQ ID NO: 259 | AAGAGUUGGAGAGUAUAGUCU | SEQ ID NO: 902 | ACUAUACUCUCCAACUCUUUC | SEQ ID NO: 1545 | AAGAGUUGGAGAGUAUAGU | 0.292 |
| AH0259 | SEQ ID NO: 260 | AGAGUUGGAGAGUAUAGUCUA | SEQ ID NO: 903 | GACUAUACUCUCCAACUCUUU | SEQ ID NO: 1546 | AGAGUUGGAGAGUAUAGUC | 0.178 |
| AH0260 | SEQ ID NO: 261 | GAGUUGGAGAGUAUAGUCUAU | SEQ ID NO: 904 | AGACUAUACUCUCCAACUCUU | SEQ ID NO: 1547 | GAGUUGGAGAGUAUAGUCU | 0.088 |
| AH0261 | SEQ ID NO: 262 | AGUUGGAGAGUAUAGUCUAUA | SEQ ID NO: 905 | UAGACUAUACUCUCCAACUCU | SEQ ID NO: 1548 | AGUUGGAGAGUAUAGUCUA | 0.034 |
| AH0262 | SEQ ID NO: 263 | GUUGGAGAGUAUAGUCUAUAC | SEQ ID NO: 906 | AUAGACUAUACUCUCCAACUC | SEQ ID NO: 1549 | GUUGGAGAGUAUAGUCUAU | 0.046 |
| AH0263 | SEQ ID NO: 264 | UUGGAGAGUAUAGUCUAUACA | SEQ ID NO: 907 | UAUAGACUAUACUCUCCAACU | SEQ ID NO: 1550 | UUGGAGAGUAUAGUCUAUA | 0.187 |

TABLE 1-continued

| Double stranded nucleic acid No. | SEQ ID NO: | Sense strand sequence (5'--->3') | SEQ ID NO: | Antisense strand sequence (5'--->3') | SEQ ID NO: | Target APCS mRNA sequence | APCS relative expression level |
|---|---|---|---|---|---|---|---|
| AH0264 | SEQ ID NO: 265 | UGGAGAGUAUAGUCUAUACAU | SEQ ID NO: 908 | GUAUAGACUAUACUCUCCAAC | SEQ ID NO: 1551 | UGGAGAGUAUAGUCUAUAC | 0.357 |
| AH0265 | SEQ ID NO: 266 | GGAGAGUAUAGUCUAUACAUU | SEQ ID NO: 909 | UGUAUAGACUAUACUCUCCAA | SEQ ID NO: 1552 | GGAGAGUAUAGUCUAUACA | 0.133 |
| AH0266 | SEQ ID NO: 267 | GAGAGUAUAGUCUAUACAUUG | SEQ ID NO: 910 | AUGUAUAGACUAUACUCUCCA | SEQ ID NO: 1553 | GAGAGUAUAGUCUAUACAU | 0.430 |
| AH0267 | SEQ ID NO: 268 | AGAGUAUAGUCUAUACAUUGG | SEQ ID NO: 911 | AAUGUAUAGACUAUACUCUCC | SEQ ID NO: 1554 | AGAGUAUAGUCUAUACAUU | 0.079 |
| AH0268 | SEQ ID NO: 269 | GAGUAUAGUCUAUACAUUGGA | SEQ ID NO: 912 | CAAUGUAUAGACUAUACUCUC | SEQ ID NO: 1555 | GAGUAUAGUCUAUACAUUG | 0.139 |
| AH0269 | SEQ ID NO: 270 | AGUAUAGUCUAUACAUUGGAA | SEQ ID NO: 913 | CCAAUGUAUAGACUAUACUCU | SEQ ID NO: 1556 | AGUAUAGUCUAUACAUUGG | 0.291 |
| AH0270 | SEQ ID NO: 271 | GUAUAGUCUAUACAUUGGAAG | SEQ ID NO: 914 | UCCAAUGUAUAGACUAUACUC | SEQ ID NO: 1557 | GUAUAGUCUAUACAUUGGA | 0.145 |
| AH0271 | SEQ ID NO: 272 | GUCUAUACAUUGGAAGACACA | SEQ ID NO: 915 | UGUCUUCCAAUGUAUAGACUA | SEQ ID NO: 1558 | GUCUAUACAUUGGAAGACA | 0.249 |
| AH0272 | SEQ ID NO: 273 | CUAUACAUUGGAAGACACAAA | SEQ ID NO: 916 | UUGUCUUCCAAUGUAUAGAC | SEQ ID NO: 1559 | CUAUACAUUGGAAGACACA | 0.165 |
| AH0273 | SEQ ID NO: 274 | UAUACAUUGGAAGACACAAAG | SEQ ID NO: 917 | UUUGUGUCUUCCAAUGUAUAG | SEQ ID NO: 1560 | UAUACAUUGGAAGACACAA | 0.312 |
| AH0274 | SEQ ID NO: 275 | AUACAUUGGAAGACACAAAGU | SEQ ID NO: 918 | UUUUGUGUCUUCCAAUGUAUA | SEQ ID NO: 1561 | AUACAUUGGAAGACACAAA | 0.296 |
| AH0275 | SEQ ID NO: 276 | ACAUUGGAAGACACAAAGUUA | SEQ ID NO: 919 | ACUUUGUGUCUUCCAAUGUAU | SEQ ID NO: 1562 | ACAUUGGAAGACACAAAGU | 0.362 |
| AH0276 | SEQ ID NO: 277 | CAUUGGAAGACACAAAGUUAC | SEQ ID NO: 920 | AACUUUGUGUCUUCCAAUGUA | SEQ ID NO: 1563 | CAUUGGAAGACACAAAGUU | 0.098 |
| AH0277 | SEQ ID NO: 278 | AUUGGAAGACACAAAGUUACA | SEQ ID NO: 921 | UAACUUUGUGUCUUCCAAUGU | SEQ ID NO: 1564 | AUUGGAAGACACAAAGUUA | 0.165 |
| AH0278 | SEQ ID NO: 279 | UGGAAGACACAAAGUUACAUC | SEQ ID NO: 922 | UGUAACUUUGUGUCUUCCAAU | SEQ ID NO: 1565 | UGGAAGACACAAAGUUACA | 0.257 |
| AH0279 | SEQ ID NO: 280 | GGAAGACACAAAGUUACAUCC | SEQ ID NO: 923 | AUGUAACUUUGUGUCUUCCAA | SEQ ID NO: 1566 | GGAAGACACAAAGUUACAU | 0.191 |
| AH0280 | SEQ ID NO: 281 | GAAGACACAAAGUUACAUCCA | SEQ ID NO: 924 | GAUGUAACUUUGUGUCUUCCA | SEQ ID NO: 1567 | GAAGACACAAAGUUACAUC | 0.353 |
| AH0281 | SEQ ID NO: 282 | AAGACACAAAGUUACAUCCAA | SEQ ID NO: 925 | GGAUGUAACUUUGUGUCUUCC | SEQ ID NO: 1568 | AAGACACAAAGUUACAUCC | 0.390 |
| AH0282 | SEQ ID NO: 283 | AGACACAAAGUUACAUCCAAA | SEQ ID NO: 926 | UGGAUGUAACUUUGUGUCUUC | SEQ ID NO: 1569 | AGACACAAAGUUACAUCCA | 0.281 |
| AH0283 | SEQ ID NO: 284 | GACACAAAGUUACAUCCAAAG | SEQ ID NO: 927 | UUGGAUGUAACUUUGUGUCUU | SEQ ID NO: 1570 | GACACAAAGUUACAUCCAA | 0.059 |
| AH0284 | SEQ ID NO: 285 | ACACAAAGUUACAUCCAAAGU | SEQ ID NO: 928 | UUUGGAUGUAACUUUGUGUCU | SEQ ID NO: 1571 | ACACAAAGUUACAUCCAAA | 0.047 |
| AH0285 | SEQ ID NO: 286 | CACAAAGUUACAUCCAAAGUU | SEQ ID NO: 929 | CUUUGGAUGUAACUUUGUGUC | SEQ ID NO: 1572 | CACAAAGUUACAUCCAAAG | 0.246 |
| AH0286 | SEQ ID NO: 287 | CAAAGUUACAUCCAAAGUAU | SEQ ID NO: 930 | AACUUUGGAUGUAACUUUGUG | SEQ ID NO: 1573 | CAAAGUUACAUCCAAAGUU | 0.225 |
| AH0287 | SEQ ID NO: 288 | AAAGUUACAUCCAAAGUAUAC | SEQ ID NO: 931 | UAACUUUGGAUGUAACUUUGU | SEQ ID NO: 1574 | AAAGUUACAUCCAAAGUUA | 0.071 |

TABLE 1-continued

| Double stranded nucleic acid No. | Sense strand sequence (5'--->3') | SEQ ID NO: | Antisense strand sequence (5'--->3') | SEQ ID NO: | Target APCS mRNA sequence | SEQ ID NO: | APCS relative expression level |
|---|---|---|---|---|---|---|---|
| AH0288 | AAGUUACAUCCAAAGUUAUCG | SEQ ID NO: 289 | AUAAACUUUGGAUGUAACUUUG | SEQ ID NO: 932 | AAGUUACAUCCAAAGUUAU | SEQ ID NO: 1575 | 0.088 |
| AH0289 | AGUUACAUCCAAAGUUAUCGA | SEQ ID NO: 290 | GAUAAACUUUGGAUGUAACUUU | SEQ ID NO: 933 | AGUUACAUCCAAAGUUAUC | SEQ ID NO: 1576 | 0.276 |
| AH0290 | GUUACAUCCAAAGUUAUCGAA | SEQ ID NO: 291 | CGAUAACUUUGGAUGUAACUU | SEQ ID NO: 934 | GUUACAUCCAAAGUUAUCG | SEQ ID NO: 1577 | 0.240 |
| AH0291 | UUACAUCCAAAGUUAUCGAAA | SEQ ID NO: 292 | UCGAUAACUUUGGAUGUAACU | SEQ ID NO: 935 | UUACAUCCAAAGUUAUCGA | SEQ ID NO: 1578 | 0.352 |
| AH0292 | UACAUCCAAAGUUAUCGAAAA | SEQ ID NO: 293 | UUCGAUAACUUUGGAUGUAAC | SEQ ID NO: 936 | UACAUCCAAAGUUAUCGAA | SEQ ID NO: 1579 | 0.250 |
| AH0293 | ACAUCCAAAGUUAUCGAAAAG | SEQ ID NO: 294 | UUUCGAUAACUUUGGAUGUAA | SEQ ID NO: 937 | ACAUCCAAAGUUAUCGAAA | SEQ ID NO: 1580 | 0.266 |
| AH0294 | CAUCCAAAGUUAUCGAAAAGU | SEQ ID NO: 295 | UUUUCGAUAACUUUGGAUGUA | SEQ ID NO: 938 | CAUCCAAAGUUAUCGAAAA | SEQ ID NO: 1581 | 0.052 |
| AH0295 | AUCCAAAGUUAUCGAAAAGUU | SEQ ID NO: 296 | CUUUUCGAUAACUUUGGAUGU | SEQ ID NO: 939 | AUCCAAAGUUAUCGAAAAG | SEQ ID NO: 1582 | 0.245 |
| AH0296 | UCCAAAGUUAUCGAAAAGUUC | SEQ ID NO: 297 | ACUUUUCGAUAACUUUGGAUG | SEQ ID NO: 940 | UCCAAAGUUAUCGAAAAGU | SEQ ID NO: 1583 | 0.378 |
| AH0297 | CCAAAGUUAUCGAAAAGUUCC | SEQ ID NO: 298 | AACUUUUCGAUAACUUUGGA | SEQ ID NO: 941 | CCAAAGUUAUCGAAAAGUU | SEQ ID NO: 1584 | 0.131 |
| AH0298 | CAAAGUUAUCGAAAAGUUCCC | SEQ ID NO: 299 | GAACUUUUCGAUAACUUUGGA | SEQ ID NO: 942 | CAAAGUUAUCGAAAAGUUC | SEQ ID NO: 1585 | 0.062 |
| AH0299 | AAAGUUAUCGAAAAGUUCCCG | SEQ ID NO: 300 | UGGAGCCGGGAACUUUUCGAU | SEQ ID NO: 943 | AAAGUUAUCGAAAAGUUCC | SEQ ID NO: 1586 | 0.329 |
| AH0300 | AAGUUAUCGAAAAGUUCCCGG | SEQ ID NO: 301 | ACUGGAGCCGGGAACUUUUCG | SEQ ID NO: 944 | AAGUUAUCGAAAAGUUCCC | SEQ ID NO: 1587 | 0.346 |
| AH0301 | AGUUAUCGAAAAGUUCCCGGA | SEQ ID NO: 302 | GAUGUGGAGCCGGGAACUUUUC | SEQ ID NO: 945 | AGUUAUCGAAAAGUUCCCG | SEQ ID NO: 1588 | 0.368 |
| AH0302 | GUUAUCGAAAAGUUCCCGGAG | SEQ ID NO: 303 | CAGAUGUGGAGCCGGGAACUUU | SEQ ID NO: 946 | GUUAUCGAAAAGUUCCCGG | SEQ ID NO: 1589 | 0.296 |
| AH0303 | UUAUCGAAAAGUUCCCGGAGC | SEQ ID NO: 304 | ACAGAUGUGGAGCCGGGAACUUG | SEQ ID NO: 947 | UUAUCGAAAAGUUCCCGGA | SEQ ID NO: 1590 | 0.273 |
| AH0304 | UAUCGAAAAGUUCCCGGAGCC | SEQ ID NO: 305 | CACAGAUGUGGAGCCGGGAACG | SEQ ID NO: 948 | UAUCGAAAAGUUCCCGGAG | SEQ ID NO: 1591 | 0.075 |
| AH0305 | AUCGAAAAGUUCCCGGAGCCG | SEQ ID NO: 306 | ACACAGAUGUGGAGCCGGGACC | SEQ ID NO: 949 | AUCGAAAAGUUCCCGGAGCC | SEQ ID NO: 1592 | 0.280 |
| AH0306 | UCGAAAAGUUCCCGGAGCCGG | SEQ ID NO: 307 | UCACAGAUGUGGAGCCGGGAG | SEQ ID NO: 950 | UCGAAAAGUUCCCGGAGCC | SEQ ID NO: 1593 | 0.479 |
| AH0307 | CGAAAAGUUCCCGGAGCCGGG | SEQ ID NO: 308 | UCACACAGAUGUGGAGCCGGG | SEQ ID NO: 951 | CGAAAAGUUCCCGGAGCC | SEQ ID NO: 1594 | 0.452 |
| AH0308 | GAAAAGUUCCCGGAGCCGGGA | SEQ ID NO: 309 | AGCUCACACAGAUGUGGAGCUG | SEQ ID NO: 952 | GAAAAGUUCCCGGAGCCGG | SEQ ID NO: 1595 | 0.377 |
| AH0309 | AAAAGUUCCCGGAGCCGGGAAG | SEQ ID NO: 310 | CCAGCUCACACAGAUGUGGAC | SEQ ID NO: 953 | AAAAGUUCCCGGAGCCGGGA | SEQ ID NO: 1596 | 0.255 |
| AH0310 | AAAGUUCCCGGAGCCGGGAGU | SEQ ID NO: 311 | UCCCAGCUCACACAGAUGUGC | SEQ ID NO: 954 | AAAGUUCCCGGAGCCGGGAGU | SEQ ID NO: 1597 | 0.317 |
| AH0311 | AGUUCCCGGAGCCGGGAGUCC | SEQ ID NO: 312 | ACUCCCAGCUCACACAGAUGU | SEQ ID NO: 955 | AGUUCCCGGAGCCGGGAGUCCC | SEQ ID NO: 1598 | 0.234 |

TABLE 1-continued

| Double stranded nucleic acid No. | Sense strand sequence (5'--->3') | SEQ ID NO: | Antisense strand sequence (5'--->3') | SEQ ID NO: | Target APCS mRNA sequence | APCS relative expression level |
|---|---|---|---|---|---|---|
| AH0312 | GUGUGAGCUGGGAGUCCUCAU | SEQ ID NO: 313 | GAGGACUCCCAGCUCACACAG | SEQ ID NO: 956 | GUGUGAGCUGGGAGUCCUC | SEQ ID NO: 1599 | 0.139 |
| AH0313 | AGCUGGGAGUCCUCCAGCAGGU | SEQ ID NO: 314 | CUGAUGGAGGACUCCCAGCUCA | SEQ ID NO: 957 | AGCUGGGAGUCCUCCAUCAG | SEQ ID NO: 1600 | 0.237 |
| AH0314 | GCUGGGAGUCCUCCAUCAGGUA | SEQ ID NO: 315 | CCUGAUGAGGAGACUCCCAGCUC | SEQ ID NO: 958 | GCUGGGAGUCCUCCAUCAGG | SEQ ID NO: 1601 | 0.223 |
| AH0315 | CUGGGAGUCCUCCAUCAGGUAU | SEQ ID NO: 316 | ACCUGAUGAGGAGACUCCCAGCU | SEQ ID NO: 959 | CUGGGAGUCCUCCAUCAGGU | SEQ ID NO: 1602 | 0.093 |
| AH0316 | UGGGAGUCCUCCAUCAGGUAUU | SEQ ID NO: 317 | UACCUGAUGAGGAGACUCCCAGC | SEQ ID NO: 960 | UGGGAGUCCUCCAUCAGGUA | SEQ ID NO: 1603 | 0.062 |
| AH0317 | GGGAGUCCUCCAUCAGGUAUUG | SEQ ID NO: 318 | AUACCUGAUGAGGAGACUCCCAG | SEQ ID NO: 961 | GGGAGUCCUCCAUCAGGUAU | SEQ ID NO: 1604 | 0.218 |
| AH0318 | GGAGUCCUCCAUCAGGUAUUGC | SEQ ID NO: 319 | AAUACCUGAUGAGGACUCCCA | SEQ ID NO: 962 | GGAGUCCUCCAUCAGGUAUU | SEQ ID NO: 1605 | 0.117 |
| AH0319 | GAGUCCUCCAUCAGGUAUUGCU | SEQ ID NO: 320 | CAAUACCUGAUGAGGAGACUCCC | SEQ ID NO: 963 | GAGUCCUCCAUCAGGUAUUG | SEQ ID NO: 1606 | 0.271 |
| AH0320 | GUCCUCCAUCAGGUAUUGCUGA | SEQ ID NO: 321 | AGCAAUACCUGAUGAGGAGACUC | SEQ ID NO: 964 | GUCCUCCAUCAGGUAUUGCU | SEQ ID NO: 1607 | 0.076 |
| AH0321 | UCCUCCAUCAGGUAUUGCUGAA | SEQ ID NO: 322 | CAGCAAUACCUGAUGAGGAGACU | SEQ ID NO: 965 | UCCUCCAUCAGGUAUUGCUG | SEQ ID NO: 1608 | 0.343 |
| AH0322 | CCUCCAUCAGGUAUUGCUGAAU | SEQ ID NO: 323 | UCAGCAAUACCUGAUGAGGAGAC | SEQ ID NO: 966 | CCUCCAUCAGGUAUUGCUGA | SEQ ID NO: 1609 | 0.104 |
| AH0323 | CUCCAUCAGGUAUUGCUGAAUU | SEQ ID NO: 324 | UUCAGCAAUACCUGAUGAGGAGA | SEQ ID NO: 967 | CUCCAUCAGGUAUUGCUGAA | SEQ ID NO: 1610 | 0.105 |
| AH0324 | UCAUCAGGUAUUGCUGAAUUUG | SEQ ID NO: 325 | AUUCAGCAAUACCUGAUGAGGAG | SEQ ID NO: 968 | UCAUCAGGUAUUGCUGAAU | SEQ ID NO: 1611 | 0.246 |
| AH0325 | CAUCAGGUAUUGCUGAAUUUUG | SEQ ID NO: 326 | AAUUCAGCAAUACCUGAUGAG | SEQ ID NO: 969 | CAUCAGGUAUUGCUGAAUU | SEQ ID NO: 1612 | 0.137 |
| AH0326 | AUCAGGUAUUGCUGAAUUUUGG | SEQ ID NO: 327 | AAAUUCAGCAAUACCUGAUGA | SEQ ID NO: 970 | AUCAGGUAUUGCUGAAUUU | SEQ ID NO: 1613 | 0.067 |
| AH0327 | UCAGGUAUUGCUGAAUUUUGGA | SEQ ID NO: 328 | AAAAUUCAGCAAUACCUGAUG | SEQ ID NO: 971 | UCAGGUAUUGCUGAAUUUU | SEQ ID NO: 1614 | 0.243 |
| AH0328 | CAGGUAUUGCUGAAUUUUGGAU | SEQ ID NO: 329 | CAAAAUUCAGCAAUACCUGAU | SEQ ID NO: 972 | CAGGUAUUGCUGAAUUUUG | SEQ ID NO: 1615 | 0.240 |
| AH0329 | AGGUAUUGCUGAAUUUUGGAUC | SEQ ID NO: 330 | CCAAAAUUCAGCAAUACCUGA | SEQ ID NO: 973 | AGGUAUUGCUGAAUUUUGG | SEQ ID NO: 1616 | 0.069 |
| AH0330 | GGUAUUGCUGAAUUUUGGAUCA | SEQ ID NO: 331 | UCCAAAAUUCAGCAAUACCUG | SEQ ID NO: 974 | GGUAUUGCUGAAUUUUGGA | SEQ ID NO: 1617 | 0.078 |
| AH0331 | GUAUUGCUGAAUUUUGGAUCAU | SEQ ID NO: 332 | AUCCAAAAUUCAGCAAUACCU | SEQ ID NO: 975 | GUAUUGCUGAAUUUUGGAU | SEQ ID NO: 1618 | 0.165 |
| AH0332 | AUUGCUGAAUUUUGGAUCAAU | SEQ ID NO: 333 | UGAUCCAAAAUUCAGCAAUAC | SEQ ID NO: 976 | AUUGCUGAAUUUUGGAUCA | SEQ ID NO: 1619 | 0.178 |
| AH0333 | UGCUGAAUUUUGGAUCAAUGG | SEQ ID NO: 334 | AUUGAUCCAAAAUUCAGCAA | SEQ ID NO: 977 | UGCUGAAUUUUGGAUCAAU | SEQ ID NO: 1620 | 0.220 |
| AH0334 | GCUGAAUUUUGGAUCAAUGGGA | SEQ ID NO: 335 | CAUUGAUCCAAAAUUCAGCA | SEQ ID NO: 978 | GCUGAAUUUUGGAUCAAUG | SEQ ID NO: 1621 | 0.160 |
| AH0335 | CUGAAUUUUGGAUCAAUGGAA | SEQ ID NO: 336 | CCAUUGAUCCAAAAUUCAGCA | SEQ ID NO: 979 | CUGAAUUUUGGAUCAAUGG | SEQ ID NO: 1622 | 0.311 |

TABLE 1 -continued

| Double stranded nucleic acid No. | Sense strand sequence (5'--->3') | SEQ ID NO: | Antisense strand sequence (5'--->3') | SEQ ID NO: | Target APCS mRNA sequence | SEQ ID NO: | APCS relative expression level |
|---|---|---|---|---|---|---|---|
| AH0336 | GAAUUUGGAUCAUGGGACA | SEQ ID NO: 337 | UCCCAUUGAUCCAAAAUUCAG | SEQ ID NO: 980 | GAAUUUGGAUCAAUGGGA | SEQ ID NO: 1623 | 0.130 |
| AH0337 | GGAUCAAUGGGACACCUUGG | SEQ ID NO: 338 | AAAGGUGUCCCAUUGAUCCAA | SEQ ID NO: 981 | GGAUCAAUGGGACACCUUU | SEQ ID NO: 1624 | 0.129 |
| AH0338 | CAAUGGGACACCUUUGGUGAA | SEQ ID NO: 339 | CACCAAAGGUGUCCCAUUGAU | SEQ ID NO: 982 | CAAUGGGACACCUUUGGUG | SEQ ID NO: 1625 | 0.365 |
| AH0339 | AAUGGGACACCUUUGGUGAAA | SEQ ID NO: 340 | UCACCAAAGGUGUCCCAUUGA | SEQ ID NO: 983 | AAUGGGACACCUUUGGUGA | SEQ ID NO: 1626 | 0.257 |
| AH0340 | AUGGGACACCUUUGGUGAAAA | SEQ ID NO: 341 | UUCACCAAAGGUGUCCCAUUG | SEQ ID NO: 984 | AUGGGACACCUUUGGUGAA | SEQ ID NO: 1627 | 0.333 |
| AH0341 | UGGGACACCUUUGGUGAAAAA | SEQ ID NO: 342 | UUUCACCAAAGGUGUCCCAU | SEQ ID NO: 985 | UGGGACACCUUUGGUGAAA | SEQ ID NO: 1628 | 0.326 |
| AH0342 | GGGACACCUUUGGUGAAAAAG | SEQ ID NO: 343 | UUUUCACCAAAGGUGUCCCA | SEQ ID NO: 986 | GGGACACCUUUGGUGAAAA | SEQ ID NO: 1629 | 0.195 |
| AH0343 | GGACACCUUUGGUGAAAAAGG | SEQ ID NO: 344 | UUUUUCACCAAAGGUGUCCCA | SEQ ID NO: 987 | GGACACCUUUGGUGAAAAA | SEQ ID NO: 1630 | 0.122 |
| AH0344 | ACCUUUGGUGAAAAAGGGUCU | SEQ ID NO: 345 | ACCCUUUUUCACCAAAGGUGU | SEQ ID NO: 988 | ACCUUUGGUGAAAAAGGGU | SEQ ID NO: 1631 | 0.253 |
| AH0345 | CCUUUGGUGAAAAAGGGUCUG | SEQ ID NO: 346 | GACCCUUUUUCACCAAAGGU | SEQ ID NO: 989 | CCUUUGGUGAAAAAGGGUC | SEQ ID NO: 1632 | 0.440 |
| AH0346 | CUUUGGUGAAAAAGGGUCUGC | SEQ ID NO: 347 | AGACCCUUUUUCACCAAAGGU | SEQ ID NO: 990 | CUUUGGUGAAAAAGGGUCU | SEQ ID NO: 1633 | 0.125 |
| AH0347 | GGUGAAAAAGGGUCUGCGACA | SEQ ID NO: 348 | UCGCAGACCCUUUUUCACCAA | SEQ ID NO: 991 | GGUGAAAAAGGGUCUGCGA | SEQ ID NO: 1634 | 0.082 |
| AH0348 | GUGAAAAAGGGUCUGCGACAG | SEQ ID NO: 349 | GUCGCAGACCCUUUUUCACCA | SEQ ID NO: 992 | GUGAAAAAGGGUCUGCGAC | SEQ ID NO: 1635 | 0.270 |
| AH0349 | UGAAAAAGGGUCUGCGACAGG | SEQ ID NO: 350 | UGUCGCAGACCCUUUUUCACC | SEQ ID NO: 993 | UGAAAAAGGGUCUGCGACA | SEQ ID NO: 1636 | 0.375 |
| AH0350 | GAAAAAGGGUCUGCGACAGGG | SEQ ID NO: 351 | CUGUCGCAGACCCUUUUUCAC | SEQ ID NO: 994 | GAAAAAGGGUCUGCGACAG | SEQ ID NO: 1637 | 0.376 |
| AH0351 | AAAGGGUCUGCGACAGGGUUA | SEQ ID NO: 352 | ACCCUGUCGCAGACCCUUUUU | SEQ ID NO: 995 | AAAGGGUCUGCGACAGGGU | SEQ ID NO: 1638 | 0.326 |
| AH0352 | AAGGGUCUGCGACAGGGUUAC | SEQ ID NO: 353 | AACCCUGUCGCAGACCCUUUU | SEQ ID NO: 996 | AAGGGUCUGCGACAGGGUU | SEQ ID NO: 1639 | 0.192 |
| AH0353 | AGGGUCUGCGACAGGGUUACU | SEQ ID NO: 354 | UAACCCUGUCGCAGACCCUUU | SEQ ID NO: 997 | AGGGUCUGCGACAGGGUUA | SEQ ID NO: 1640 | 0.106 |
| AH0354 | GGGUCUGCGACAGGGUUACUU | SEQ ID NO: 355 | GUAACCCUGUCGCAGACCCUU | SEQ ID NO: 998 | GGGUCUGCGACAGGGUUAC | SEQ ID NO: 1641 | 0.098 |
| AH0355 | GGUCUGCGACAGGGUUACUUU | SEQ ID NO: 356 | AGUAACCCUGUCGCAGACCCU | SEQ ID NO: 999 | GGUCUGCGACAGGGUUACU | SEQ ID NO: 1642 | 0.195 |
| AH0356 | GUCUGCGACAGGGUUACUUUG | SEQ ID NO: 357 | AAGUAACCCUGUCGCAGACCC | SEQ ID NO: 1000 | GUCUGCGACAGGGUUACUU | SEQ ID NO: 1643 | 0.154 |
| AH0357 | UCUGCGACAGGGUUACUUUGU | SEQ ID NO: 358 | AAAGUAACCCUGUCGCAGACC | SEQ ID NO: 1001 | UCUGCGACAGGGUUACUUU | SEQ ID NO: 1644 | 0.126 |
| AH0358 | CUGCGACAGGGUUACUUUGUA | SEQ ID NO: 359 | CAAAGUAACCCUGUCGCAGAC | SEQ ID NO: 1002 | CUGCGACAGGGUUACUUUG | SEQ ID NO: 1645 | 0.120 |
| AH0359 | UGCGACAGGGUUACUUUGUAG | SEQ ID NO: 360 | ACAAAGUAACCCUGUCGCAGA | SEQ ID NO: 1003 | UGCGACAGGGUUACUUUGU | SEQ ID NO: 1646 | 0.438 |

TABLE 1-continued

| Double stranded nucleic acid No. | Sense strand sequence (5'--->3') | SEQ ID NO: | Antisense strand sequence (5'--->3') | SEQ ID NO: | Target APCS mRNA sequence | SEQ ID NO: | APCS relative expression level |
|---|---|---|---|---|---|---|---|
| AH0360 | GCGACAGGGUUACUUUGUAGA | SEQ ID NO: 361 | UACAAAGUAACCCUGUCGCAG | SEQ ID NO: 1004 | GCGACAGGGUUACUUUGUA | SEQ ID NO: 1647 | 0.104 |
| AH0361 | CGACAGGGUUACUUUGUAGAA | SEQ ID NO: 362 | CUACAAAGUAACCCUGUCGCA | SEQ ID NO: 1005 | CGACAGGGUUACUUUGUAG | SEQ ID NO: 1648 | 0.290 |
| AH0362 | GACAGGGUUACUUUGUAGAAG | SEQ ID NO: 363 | UCUACAAAGUAACCCUGUCGC | SEQ ID NO: 1006 | GACAGGGUUACUUUGUAGA | SEQ ID NO: 1649 | 0.453 |
| AH0363 | ACAGGGUUACUUUGUAGAAGC | SEQ ID NO: 364 | UUCUACAAAGUAACCCUGUCG | SEQ ID NO: 1007 | ACAGGGUUACUUUGUAGAA | SEQ ID NO: 1650 | 0.467 |
| AH0364 | CAGGGUUACUUUGUAGAAGCU | SEQ ID NO: 365 | CUUCUACAAAGUAACCCUGUC | SEQ ID NO: 1008 | CAGGGUUACUUUGUAGAAG | SEQ ID NO: 1651 | 0.156 |
| AH0365 | AGGGUUACUUUGUAGAAGCUC | SEQ ID NO: 366 | GCUUCUACAAAGUAACCCUGU | SEQ ID NO: 1009 | AGGGUUACUUUGUAGAAGC | SEQ ID NO: 1652 | 0.280 |
| AH0366 | GGGUUACUUUGUAGAAGCUCA | SEQ ID NO: 367 | AGCUUCUACAAAGUAACCCUG | SEQ ID NO: 1010 | GGGUUACUUUGUAGAAGCU | SEQ ID NO: 1653 | 0.179 |
| AH0367 | GGUUACUUUGUAGAAGCUCAG | SEQ ID NO: 368 | GAGCUUCUACAAAGUAACCCU | SEQ ID NO: 1011 | GGUUACUUUGUAGAAGCUC | SEQ ID NO: 1654 | 0.222 |
| AH0368 | GUUACUUUGUAGAAGCUCAGC | SEQ ID NO: 369 | UGAGCUUCUACAAAGUAACCC | SEQ ID NO: 1012 | GUUACUUUGUAGAAGCUCA | SEQ ID NO: 1655 | 0.083 |
| AH0369 | UUACUUUGUAGAAGCUCAGCU | SEQ ID NO: 370 | CUGAGCUUCUACAAAGUAACC | SEQ ID NO: 1013 | UUACUUUGUAGAAGCUCAG | SEQ ID NO: 1656 | 0.313 |
| AH0370 | UACUUUGUAGAAGCUCAGCUC | SEQ ID NO: 371 | GCUGAGCUUCUACAAAGUAAC | SEQ ID NO: 1014 | UACUUUGUAGAAGCUCAGC | SEQ ID NO: 1657 | 0.088 |
| AH0371 | ACUUUGUAGAAGCUCAGCUCA | SEQ ID NO: 372 | AGCUGAGCUUCUACAAAGUAA | SEQ ID NO: 1015 | ACUUUGUAGAAGCUCAGCU | SEQ ID NO: 1658 | 0.093 |
| AH0372 | CUUUGUAGAAGCUCAGCUCAG | SEQ ID NO: 373 | CAGCUGAGCUUCUACAAAGUA | SEQ ID NO: 1016 | CUUUGUAGAAGCUCAGCUC | SEQ ID NO: 1659 | 0.142 |
| AH0373 | UUUGUAGAAGCUCAGCUCAGG | SEQ ID NO: 374 | UCAGCUGAGCUUCUACAAAGU | SEQ ID NO: 1017 | UUUGUAGAAGCUCAGCUCA | SEQ ID NO: 1660 | 0.255 |
| AH0374 | UUGUAGAAGCUCAGCUCAGGG | SEQ ID NO: 375 | CUCAGCUGAGCUUCUACAAAG | SEQ ID NO: 1018 | UUGUAGAAGCUCAGCUCAG | SEQ ID NO: 1661 | 0.308 |
| AH0375 | UGUAGAAGCUCAGCUCAGGGC | SEQ ID NO: 376 | CCUCAGCUGAGCUUCUACAAA | SEQ ID NO: 1019 | UGUAGAAGCUCAGCUCAGG | SEQ ID NO: 1662 | 0.097 |
| AH0376 | GUAGAAGCUCAGCUCAGGGCA | SEQ ID NO: 377 | CCCUCAGCUGAGCUUCUACAA | SEQ ID NO: 1020 | GUAGAAGCUCAGCUCAGGG | SEQ ID NO: 1663 | 0.316 |
| AH0377 | UAGAAGCUCAGCUCAGGGCAG | SEQ ID NO: 378 | CCCCUCAGCUGAGCUUCUACA | SEQ ID NO: 1021 | UAGAAGCUCAGCUCAGGGC | SEQ ID NO: 1664 | 0.116 |
| AH0378 | AGAAGCUCAGCUCAGGGCAGG | SEQ ID NO: 379 | CCCCCUCAGCUGAGCUUCUAC | SEQ ID NO: 1022 | AGAAGCUCAGCUCAGGGCA | SEQ ID NO: 1665 | 0.193 |
| AH0379 | GAAGCUCAGCUCAGGGCAGGA | SEQ ID NO: 380 | UCCCCCUCAGCUGAGCUUCUA | SEQ ID NO: 1023 | GAAGCUCAGCUCAGGGCAG | SEQ ID NO: 1666 | 0.432 |
| AH0380 | AAGCUCAGCUCAGGGCAGGAU | SEQ ID NO: 381 | AUCCCCCUCAGCUGAGCUUCU | SEQ ID NO: 1024 | AAGCUCAGCUCAGGGCAGG | SEQ ID NO: 1667 | 0.170 |
| AH0381 | AGCUCAGCUCAGGGCAGGAUU | SEQ ID NO: 382 | AAUCCCCCUCAGCUGAGCUUC | SEQ ID NO: 1025 | AGCUCAGCUCAGGGCAGGA | SEQ ID NO: 1668 | 0.448 |
| AH0382 | GCUCAGCUCAGGGCAGGAUUC | SEQ ID NO: 383 | GAAUCCCCCUCAGCUGAGCUU | SEQ ID NO: 1026 | GCUCAGCUCAGGGCAGGAU | SEQ ID NO: 1669 | 0.494 |
| AH0383 | CUCAGCUCAGGGCAGGAUUCC | SEQ ID NO: 384 | GGAAUCCCCCUCAGCUGAGCU | SEQ ID NO: 1027 | CUCAGCUCAGGGCAGGAUU | SEQ ID NO: 1670 | 0.244 |

TABLE 1 -continued

| Double stranded nucleic acid No. | SEQ ID NO: | Sense strand sequence (5'--->3') | SEQ ID NO: | Antisense strand sequence (5'--->3') | SEQ ID NO: | Target APCS mRNA sequence | APCS relative expression level |
|---|---|---|---|---|---|---|---|
| AH0384 | SEQ ID NO: 385 | GGCAGGAACAGGAUUCCUAUG | SEQ ID NO: 1028 | UAGGAAUCCUGUUCCUGCCCC | SEQ ID NO: 1671 | GGCAGGAACAGGAUUCCUA | 0.074 |
| AH0385 | SEQ ID NO: 386 | GCAGGAACAGGAUUCCUAUGG | SEQ ID NO: 1029 | AUAGGAAUCCUGUUCCUGCCC | SEQ ID NO: 1672 | GCAGGAACAGGAUUCCUAU | 0.146 |
| AH0386 | SEQ ID NO: 387 | CAGGAACAGGAUUCCUAUGGG | SEQ ID NO: 1030 | CAUAGGAAUCCUGUUCCUGCC | SEQ ID NO: 1673 | CAGGAACAGGAUUCCUAUG | 0.280 |
| AH0387 | SEQ ID NO: 388 | GGAACAGGAUUCCUAUGGGGG | SEQ ID NO: 1031 | CCCCAUAGGAAUCCUGUUCCUG | SEQ ID NO: 1674 | GGAACAGGAUUCCUAUGGG | 0.260 |
| AH0388 | SEQ ID NO: 389 | GAACAGGAUUCCUAUGGGGGC | SEQ ID NO: 1032 | CCCCCAUAGGAAUCCUGUUCC | SEQ ID NO: 1675 | GAACAGGAUUCCUAUGGGG | 0.437 |
| AH0389 | SEQ ID NO: 390 | ACAGGAUUCCUAUGGGGGCAA | SEQ ID NO: 1033 | GCCCCCAUAGGAAUCCUGUUC | SEQ ID NO: 1676 | ACAGGAUUCCUAUGGGGGC | 0.349 |
| AH0390 | SEQ ID NO: 391 | CAGGAUUCCUAUGGGGGCAAG | SEQ ID NO: 1034 | UGCCCCCAUAGGAAUCCUGUU | SEQ ID NO: 1677 | CAGGAUUCCUAUGGGGGCA | 0.279 |
| AH0391 | SEQ ID NO: 392 | GGAUUCCUAUGGGGGCAAGUU | SEQ ID NO: 1035 | CUUGCCCCCAUAGGAAUCCUG | SEQ ID NO: 1678 | GGAUUCCUAUGGGGGCAAG | 0.153 |
| AH0392 | SEQ ID NO: 393 | GAUUCCUAUGGGGGCAAGUUU | SEQ ID NO: 1036 | ACUUGCCCCCAUAGGAAUCCU | SEQ ID NO: 1679 | GAUUCCUAUGGGGGCAAGU | 0.257 |
| AH0393 | SEQ ID NO: 394 | AUUCCUAUGGGGGCAAGUUUG | SEQ ID NO: 1037 | AACUUGCCCCCAUAGGAAUCC | SEQ ID NO: 1680 | AUUCCUAUGGGGGCAAGUU | 0.373 |
| AH0394 | SEQ ID NO: 395 | UUCCUAUGGGGGCAAGUUUGA | SEQ ID NO: 1038 | AAACUUGCCCCCAUAGGAAUC | SEQ ID NO: 1681 | UUCCUAUGGGGGCAAGUUU | 0.481 |
| AH0395 | SEQ ID NO: 396 | UCCUAUGGGGGCAAGUUUGAU | SEQ ID NO: 1039 | CAAACUUGCCCCCAUAGGAAU | SEQ ID NO: 1682 | UCCUAUGGGGGCAAGUUUG | 0.395 |
| AH0396 | SEQ ID NO: 397 | CCUAUGGGGGCAAGUUUGAUA | SEQ ID NO: 1040 | UCAAACUUGCCCCCAUAGGAA | SEQ ID NO: 1683 | CCUAUGGGGGCAAGUUUGA | 0.272 |
| AH0397 | SEQ ID NO: 398 | CUAUGGGGGCAAGUUUGAUAG | SEQ ID NO: 1041 | AUCAAACUUGCCCCCAUAGGA | SEQ ID NO: 1684 | CUAUGGGGGCAAGUUUGAU | 0.198 |
| AH0398 | SEQ ID NO: 399 | UAUGGGGGCAAGUUUGAUAGG | SEQ ID NO: 1042 | UAUCAAACUUGCCCCCAUAGG | SEQ ID NO: 1685 | UAUGGGGGCAAGUUUGAUA | 0.481 |
| AH0399 | SEQ ID NO: 400 | GGGGGCAAGUUUGAUAGGAGC | SEQ ID NO: 1043 | UCCUAUCAAACUUGCCCCCAU | SEQ ID NO: 1686 | GGGGGCAAGUUUGAUAGGA | 0.268 |
| AH0400 | SEQ ID NO: 401 | GGGCAAGUUUGAUAGGAGCC | SEQ ID NO: 1044 | CUCCUAUCAAACUUGCCCCCA | SEQ ID NO: 1687 | GGGCAAGUUUGAUAGGAG | 0.100 |
| AH0401 | SEQ ID NO: 402 | GGGCAAGUUUGAUAGGAGCCA | SEQ ID NO: 1045 | GCUCCUAUCAAACUUGCCCCC | SEQ ID NO: 1688 | GGGCAAGUUUGAUAGGAGC | 0.114 |
| AH0402 | SEQ ID NO: 403 | GGCAAGUUUGAUAGGAGCCAG | SEQ ID NO: 1046 | GGCUCCUAUCAAACUUGCCCC | SEQ ID NO: 1689 | GGCAAGUUUGAUAGGAGCC | 0.314 |
| AH0403 | SEQ ID NO: 404 | GCAAGUUUGAUAGGAGCCAGU | SEQ ID NO: 1047 | UGGCUCCUAUCAAACUUGCCC | SEQ ID NO: 1690 | GCAAGUUUGAUAGGAGCCA | 0.235 |
| AH0404 | SEQ ID NO: 405 | CAAGUUUGAUAGGAGCCAGUC | SEQ ID NO: 1048 | CUGGCUCCUAUCAAACUUGCC | SEQ ID NO: 1691 | CAAGUUUGAUAGGAGCCAG | 0.274 |
| AH0405 | SEQ ID NO: 406 | AAGUUUGAUAGGAGCCAGUCC | SEQ ID NO: 1049 | ACUGGCUCCUAUCAAACUUGC | SEQ ID NO: 1692 | AAGUUUGAUAGGAGCCAGU | 0.085 |
| AH0406 | SEQ ID NO: 407 | UUGAUAGGAGCCAGUCCUUUG | SEQ ID NO: 1050 | AAGGACUGGCUCCUAUCAAAC | SEQ ID NO: 1693 | UUGAUAGGAGCCAGUCCUU | 0.242 |
| AH0407 | SEQ ID NO: 408 | UGAUAGGAGCCAGUCCUUUGU | SEQ ID NO: 1051 | AAAGGACUGGCUCCUAUCAAA | SEQ ID NO: 1694 | UGAUAGGAGCCAGUCCUUU | 0.239 |

TABLE 1 -continued

| Double stranded nucleic acid No. | Sense strand SEQ ID NO | Sense strand sequence (5'--->3') | Antisense SEQ ID NO | Antisense strand sequence (5'--->3') | Target SEQ ID NO | Target APCS mRNA sequence | APCS relative expression level |
|---|---|---|---|---|---|---|---|
| AH0408 | SEQ ID NO: 409 | GAUAGGAGCCAGUCCUUUGUG | SEQ ID NO: 1052 | CAAAGGACUGGCUCCUAUCAA | SEQ ID NO: 1695 | GAUAGGAGCCAGUCCUUUG | 0.160 |
| AH0409 | SEQ ID NO: 410 | AUAGGAGCCAGUCCUUUGUGG | SEQ ID NO: 1053 | ACAAAGGACUGGCUCCUAUCA | SEQ ID NO: 1696 | AUAGGAGCCAGUCCUUUGU | 0.159 |
| AH0410 | SEQ ID NO: 411 | AGGAGCCAGUCCUUUGUGGGA | SEQ ID NO: 1054 | CCCACAAAGGACUGGCUCCUAU | SEQ ID NO: 1697 | AGGAGCCAGUCCUUUGUGG | 0.313 |
| AH0411 | SEQ ID NO: 412 | GGAGCCAGUCCUUUGUGGGAG | SEQ ID NO: 1055 | CCCACAAAGGACUGGCUCCUA | SEQ ID NO: 1698 | GGAGCCAGUCCUUUGUGGG | 0.232 |
| AH0412 | SEQ ID NO: 413 | GAGCCAGUCCUUUGUGGGAGA | SEQ ID NO: 1056 | UCCCACAAAGGACUGGCUCCU | SEQ ID NO: 1699 | GAGCCAGUCCUUUGUGGGA | 0.098 |
| AH0413 | SEQ ID NO: 414 | AGCCAGUCCUUUGUGGGAGAG | SEQ ID NO: 1057 | CUCCCACAAAGGACUGGCUCC | SEQ ID NO: 1700 | AGCCAGUCCUUUGUGGGAG | 0.325 |
| AH0414 | SEQ ID NO: 415 | GCCAGUCCUUUGUGGGAGAGA | SEQ ID NO: 1058 | UCUCCCACAAAGGACUGGCUC | SEQ ID NO: 1701 | GCCAGUCCUUUGUGGGAGA | 0.109 |
| AH0415 | SEQ ID NO: 416 | CCAGUCCUUUGUGGGAGAGAU | SEQ ID NO: 1059 | CUCUCCCACAAAGGACUGGCU | SEQ ID NO: 1702 | CCAGUCCUUUGUGGGAGAG | 0.367 |
| AH0416 | SEQ ID NO: 417 | CAGUCCUUUGUGGGAGAGAUU | SEQ ID NO: 1060 | UCUCUCCCACAAAGGACUGGC | SEQ ID NO: 1703 | CAGUCCUUUGUGGGAGAGA | 0.119 |
| AH0417 | SEQ ID NO: 418 | AGUCCUUUGUGGGAGAGAUUG | SEQ ID NO: 1061 | AAUCUCUCCCACAAAGGACUGG | SEQ ID NO: 1704 | AGUCCUUUGUGGGAGAGAU | 0.074 |
| AH0418 | SEQ ID NO: 419 | GUCCUUUGUGGGAGAGAUUGG | SEQ ID NO: 1062 | AAUCUCUCCCACAAAGGACUG | SEQ ID NO: 1705 | GUCCUUUGUGGGAGAGAUU | 0.095 |
| AH0419 | SEQ ID NO: 420 | UCCUUUGUGGGAGAGAUUGGG | SEQ ID NO: 1063 | CAAUCUCUCCCACAAAGGAC | SEQ ID NO: 1706 | UCCUUUGUGGGAGAGAUUG | 0.358 |
| AH0420 | SEQ ID NO: 421 | CCUUUGUGGGAGAGAUUGGGA | SEQ ID NO: 1064 | CCAAUCUCUCCCACAAAGGA | SEQ ID NO: 1707 | CCUUUGUGGGAGAGAUUGG | 0.315 |
| AH0421 | SEQ ID NO: 422 | CUUUGUGGGAGAGAUUGGGAA | SEQ ID NO: 1065 | CCCAAUCUCUCCCACAAAGG | SEQ ID NO: 1708 | CUUUGUGGGAGAGAUUGGG | 0.301 |
| AH0422 | SEQ ID NO: 423 | UUUGUGGGAGAGAUUGGGGAA | SEQ ID NO: 1066 | UCCCAAUCUCUCCCACAAAG | SEQ ID NO: 1709 | UUGUGGGAGAGAUUGGGGA | 0.214 |
| AH0423 | SEQ ID NO: 424 | UGUGGGAGAGAUUGGGGAUU | SEQ ID NO: 1067 | AUCCCAAUCUCUCCCACAAA | SEQ ID NO: 1710 | UGUGGGAGAGAUUGGGGAU | 0.087 |
| AH0424 | SEQ ID NO: 425 | GUGGGAGAGAUUGGGGAUUU | SEQ ID NO: 1068 | AAUCCCAAUCUCUCCCACAC | SEQ ID NO: 1711 | GUGGGAGAGAUUGGGGAUU | 0.099 |
| AH0425 | SEQ ID NO: 426 | UGGGAGAGAUUGGGGAUUUGU | SEQ ID NO: 1069 | AAAUCCCAAUCUCUCCCACA | SEQ ID NO: 1712 | UGGGAGAGAUUGGGGAUUU | 0.109 |
| AH0426 | SEQ ID NO: 427 | GGGAGAGAUUGGGGAUUUGUA | SEQ ID NO: 1070 | CAAAUCCCAAUCUCUCCCAC | SEQ ID NO: 1713 | GGGAGAGAUUGGGGAUUUG | 0.068 |
| AH0427 | SEQ ID NO: 428 | GGAGAGAUUGGGGAUUUGUAC | SEQ ID NO: 1071 | ACAAAUCCCAAUCUCUCCCA | SEQ ID NO: 1714 | GGAGAGAUUGGGGAUUUGU | 0.071 |
| AH0428 | SEQ ID NO: 429 | GAGAGAUUGGGGAUUUGUACA | SEQ ID NO: 1072 | UACAAAUCCCAAUCUCUCCC | SEQ ID NO: 1715 | GAGAGAUUGGGGAUUUGUA | 0.047 |
| AH0429 | SEQ ID NO: 430 | AGAGAUUGGGGAUUUGUACAU | SEQ ID NO: 1073 | GUACAAAUCCCAAUCUCUCC | SEQ ID NO: 1716 | AGAGAUUGGGGAUUUGUAC | 0.175 |
| AH0430 | SEQ ID NO: 431 | GAGAUUGGGGAUUUGUACAUG | SEQ ID NO: 1074 | UGUACAAAUCCCAAUCUCUC | SEQ ID NO: 1717 | GAGAUUGGGGAUUUGUACA | 0.079 |
| AH0431 | SEQ ID NO: 432 | AGAUUGGGGAUUUGUACAUGU | SEQ ID NO: 1075 | AUGUACAAAUCCCAAUCUCU | SEQ ID NO: 1718 | AGAUUGGGGAUUUGUACAU | 0.391 |

TABLE 1-continued

| Double stranded nucleic acid No. | SEQ ID NO: | Sense strand sequence (5'--->3') | SEQ ID NO: | Antisense strand sequence (5'--->3') | SEQ ID NO: | Target APCS mRNA sequence | APCS relative expression level |
|---|---|---|---|---|---|---|---|
| AH0432 | SEQ ID NO: 433 | GGGGAUUUGUACAUGUGGGAC | SEQ ID NO: 1076 | CCCACACUGUACAAAUCCCCAA | SEQ ID NO: 1719 | GGGGAUUUGUACAUGUGGG | 0.154 |
| AH0433 | SEQ ID NO: 434 | GGGAUUUGUACAUGUGGGACU | SEQ ID NO: 1077 | UCCCACACUGUACAAAUCCCCA | SEQ ID NO: 1720 | GGGAUUUGUACAUGUGGGA | 0.087 |
| AH0434 | SEQ ID NO: 435 | GGAUUUGUACAUGUGGGACUC | SEQ ID NO: 1078 | GUCCCACACUGUACAAAUCCCC | SEQ ID NO: 1721 | GGAUUUGUACAUGUGGGAC | 0.324 |
| AH0435 | SEQ ID NO: 436 | GAUUUGUACAUGUGGGACUCU | SEQ ID NO: 1079 | AGUCCCACACUGUACAAAUCCC | SEQ ID NO: 1722 | GAUUUGUACAUGUGGGACU | 0.308 |
| AH0436 | SEQ ID NO: 437 | UGUACAUGUGGGACUCUGUGU | SEQ ID NO: 1080 | ACAGAGUCCCACAUGUACAAA | SEQ ID NO: 1723 | UGUACAUGUGGGACUCUGU | 0.210 |
| AH0437 | SEQ ID NO: 438 | GUACAUGUGGGACUCUGUGCU | SEQ ID NO: 1081 | CACAGAGUCCCACAUGUACAA | SEQ ID NO: 1724 | GUACAUGUGGGACUCUGUG | 0.384 |
| AH0438 | SEQ ID NO: 439 | ACAUGUGGGACUCUGUGCUGC | SEQ ID NO: 1082 | AGCACAGAGUCCCACAUGUAC | SEQ ID NO: 1725 | ACAUGUGGGACUCUGUGCU | 0.269 |
| AH0439 | SEQ ID NO: 440 | GGGACUCUGUGCUGCCCCCAG | SEQ ID NO: 1083 | GGGGGCAGCACAGAGUCCCAC | SEQ ID NO: 1726 | GGGACUCUGUGCUGCCCCC | 0.463 |
| AH0440 | SEQ ID NO: 441 | GGACUCUGUGCUGCCCCCAGA | SEQ ID NO: 1084 | UGGGGGCAGCACAGAGUCCCA | SEQ ID NO: 1727 | GGACUCUGUGCUGCCCCCA | 0.500 |
| AH0441 | SEQ ID NO: 442 | ACUCUGUGCUGCCCCCAGAAA | SEQ ID NO: 1085 | UCUGGGGGCAGCACAGAGUCC | SEQ ID NO: 1728 | ACUCUGUGCUGCCCCCAGA | 0.308 |
| AH0442 | SEQ ID NO: 443 | CUCUGUGCUGCCCCCAGAAAA | SEQ ID NO: 1086 | UUCUGGGGGCAGCACAGAGUC | SEQ ID NO: 1729 | CUCUGUGCUGCCCCCAGAA | 0.459 |
| AH0443 | SEQ ID NO: 444 | CUGUGCUGCCCCCAGAAAAAU | SEQ ID NO: 1087 | UUUUCUGGGGGCAGCACAGAG | SEQ ID NO: 1730 | CUGUGCUGCCCCCAGAAAA | 0.134 |
| AH0444 | SEQ ID NO: 445 | UGUGCUGCCCCCAGAAAAAUA | SEQ ID NO: 1088 | AUUUUCUGGGGGCAGCACAGA | SEQ ID NO: 1731 | UGUGCUGCCCCCAGAAAAU | 0.063 |
| AH0445 | SEQ ID NO: 446 | GUGCUGCCCCCAGAAAAAUAU | SEQ ID NO: 1089 | UAUUUUCUGGGGGCAGCACAG | SEQ ID NO: 1732 | GUGCUGCCCCCAGAAAAUA | 0.433 |
| AH0446 | SEQ ID NO: 447 | GCUGCCCCCAGAAAAAUAUCC | SEQ ID NO: 1090 | GAUAUUUUCUGGGGGCAGCAC | SEQ ID NO: 1733 | GCUGCCCCCAGAAAAAUAUC | 0.414 |
| AH0447 | SEQ ID NO: 448 | CCCCCAGAAAAAUAUCCUGUCU | SEQ ID NO: 1091 | ACAGGAUAUUUUCUGGGGGCA | SEQ ID NO: 1734 | CCCCCAGAAAAAUAUCCUGU | 0.189 |
| AH0448 | SEQ ID NO: 449 | CCCCAGAAAAAUAUCCUGUCUG | SEQ ID NO: 1092 | AGACAGGAUAUUUUCUGGGGG | SEQ ID NO: 1735 | CCCCAGAAAAAUAUCCUGUCU | 0.489 |
| AH0449 | SEQ ID NO: 450 | CCAGAAAAAUAUCCUGUCUGCC | SEQ ID NO: 1093 | CAGACAGGAUAUUUUCUGGGG | SEQ ID NO: 1736 | CCAGAAAAAUAUCCUGUCUG | 0.353 |
| AH0450 | SEQ ID NO: 451 | CAGAAAAAUAUCCUGUCUGCCU | SEQ ID NO: 1094 | GCAGACAGGAUAUUUUCUGGG | SEQ ID NO: 1737 | CAGAAAAAUAUCCUGUCUGC | 0.293 |
| AH0451 | SEQ ID NO: 452 | GAAAAAUAUCCUGUCUGCCUAU | SEQ ID NO: 1095 | AGGCAGACAGGAUAUUUUCUG | SEQ ID NO: 1738 | GAAAAAUAUCCUGUCUGCCU | 0.121 |
| AH0452 | SEQ ID NO: 453 | AAAAAUAUCCUGUCUGCCUAUC | SEQ ID NO: 1096 | UAGGCAGACAGGAUAUUUUCU | SEQ ID NO: 1739 | AAAAAUAUCCUGUCUGCCUA | 0.053 |
| AH0453 | SEQ ID NO: 454 | AAAUAUCCUGUCUGCCUAUCA | SEQ ID NO: 1097 | AUAGGCAGACAGGAUAUUUUC | SEQ ID NO: 1740 | AAAUAUCCUGUCUGCCUAU | 0.109 |
| AH0454 | SEQ ID NO: 455 | CCUGUCUGCCUAUCAGGGUAC | SEQ ID NO: 1098 | ACCCUGAUAGGCAGACAGGAU | SEQ ID NO: 1741 | CCUGUCUGCCUAUCAGGGU | 0.298 |
| AH0455 | SEQ ID NO: 456 | CUGUCUGCCUAUCAGGGUACC | SEQ ID NO: 1099 | UACCCUGAUAGGCAGACAGGA | SEQ ID NO: 1742 | CUGUCUGCCUAUCAGGGUA | 0.113 |

TABLE 1 -continued

| Double stranded nucleic acid No. | SEQ ID NO: | Sense strand sequence (5'--->3') | SEQ ID NO: | Antisense strand sequence (5'--->3') | SEQ ID NO: | Target APCS mRNA sequence | APCS relative expression level |
|---|---|---|---|---|---|---|---|
| AH0456 | SEQ ID NO: 457 | GUCUGCCUAUCAGGGUACCCC | SEQ ID NO: 1100 | GGUACCCUGAUAGGCAGACAG | SEQ ID NO: 1743 | GUCUGCCUAUCAGGGUACC | 0.336 |
| AH0457 | SEQ ID NO: 458 | UGCCUAUCAGGGUACCCCUCU | SEQ ID NO: 1101 | AGGGGUACCCUGAUAGGCAGA | SEQ ID NO: 1744 | UGCCUAUCAGGGUACCCCU | 0.251 |
| AH0458 | SEQ ID NO: 459 | GCCUAUCAGGGUACCCCUCUC | SEQ ID NO: 1102 | GAGGGGUACCCUGAUAGGCAG | SEQ ID NO: 1745 | GCCUAUCAGGGUACCCUC | 0.218 |
| AH0459 | SEQ ID NO: 460 | CCUAUCAGGGUACCCCUCUCC | SEQ ID NO: 1103 | AGAGGGGUACCCUGAUAGGCA | SEQ ID NO: 1746 | CCUAUCAGGGUACCCCUCU | 0.403 |
| AH0460 | SEQ ID NO: 461 | CUAUCAGGGUACCCCUCUCCC | SEQ ID NO: 1104 | GAGAGGGGUACCCUGAUAGGC | SEQ ID NO: 1747 | CUAUCAGGGUACCCCUCUC | 0.104 |
| AH0461 | SEQ ID NO: 462 | CAGGGUACCCCUCUCCCUGCC | SEQ ID NO: 1105 | CAGGGAGAGGGGUACCCUGAU | SEQ ID NO: 1748 | CAGGGUACCCCUCUCCCUG | 0.300 |
| AH0462 | SEQ ID NO: 463 | GGGUACCCCUCUCCCUGCCA | SEQ ID NO: 1106 | GGCAGGGAGAGGGGUACCCUG | SEQ ID NO: 1749 | GGGUACCCCUCUCCCUGCC | 0.463 |
| AH0463 | SEQ ID NO: 464 | GGUACCCCUCUCCCUGCCAAU | SEQ ID NO: 1107 | UGGCAGGGAGAGGGGUACCCU | SEQ ID NO: 1750 | GGUACCCCUCUCCCUGCCA | 0.476 |
| AH0464 | SEQ ID NO: 465 | GUACCCCUCUCCCUGCCAAUA | SEQ ID NO: 1108 | UUGGCAGGGAGAGGGGUACCC | SEQ ID NO: 1751 | GUACCCCUCUCCCUGCCAA | 0.159 |
| AH0465 | SEQ ID NO: 466 | UACCCCUCUCCCUGCCAAUAU | SEQ ID NO: 1109 | AUUGGCAGGGAGAGGGGUACC | SEQ ID NO: 1752 | UACCCCUCUCCCUGCCAAU | 0.391 |
| AH0466 | SEQ ID NO: 467 | CCCCUCUCCCUGCCAAUAUCC | SEQ ID NO: 1110 | AUAUUGGCAGGGAGAGGGGUA | SEQ ID NO: 1753 | CCCCUCUCCCUGCCAAUAUC | 0.389 |
| AH0467 | SEQ ID NO: 468 | CCCUCUCCCUGCCAAUAUCCU | SEQ ID NO: 1111 | GAUAUUGCAGGGAGAGGGGU | SEQ ID NO: 1754 | CCCUCUCCCUGCCAAUAUC | 0.208 |
| AH0468 | SEQ ID NO: 469 | CUGCCAAUAUCCUGGACUGCG | SEQ ID NO: 1112 | CAGUCCAGGAUAUUGGCAGGG | SEQ ID NO: 1755 | CUGCCAAUAUCCUGGACUG | 0.333 |
| AH0469 | SEQ ID NO: 470 | CCAAUAUCCUGGACUGGCAGG | SEQ ID NO: 1113 | UGCCAGUCCAGGAUAUUGGCA | SEQ ID NO: 1756 | CCAAUAUCCUGGACUGGCA | 0.120 |
| AH0470 | SEQ ID NO: 471 | CAAUAUCCUGGACUGGCAGC | SEQ ID NO: 1114 | CUGCCAGUCCAGGAUAUUGGC | SEQ ID NO: 1757 | CAAUAUCCUGGACUGGCAG | 0.299 |
| AH0471 | SEQ ID NO: 472 | UCCUGGACUGGCAGCCUCUGA | SEQ ID NO: 1115 | AGAGCCUGCCAGUCCAGGAUA | SEQ ID NO: 1758 | UCCUGGACUGGCAGGCUCU | 0.386 |
| AH0472 | SEQ ID NO: 473 | CCUGGACUGGCAGCCUCUGAA | SEQ ID NO: 1116 | CAGAGGCCUGCCAGUCCAGGAU | SEQ ID NO: 1759 | CCUGGACUGGCAGGCUCUG | 0.463 |
| AH0473 | SEQ ID NO: 474 | CUGGACUGGCAGCCUCUGA | SEQ ID NO: 1117 | UCAGAGGCCUGCCAGUCCAGGA | SEQ ID NO: 1760 | CUGGACUGGCAGCCUCUGA | 0.454 |
| AH0474 | SEQ ID NO: 475 | UGGACUGGCAGCCUCUGAACU | SEQ ID NO: 1118 | UUCAGAGGCCUGCCAGUCCAGG | SEQ ID NO: 1761 | UGGACUGGCAGCCUCUGAA | 0.085 |
| AH0475 | SEQ ID NO: 476 | GGACUGGCAGCCUCUGAACUA | SEQ ID NO: 1119 | GUUCAGAGGCCUGCCAGUCCAG | SEQ ID NO: 1762 | GGACUGGCAGCCUCUGAAC | 0.383 |
| AH0476 | SEQ ID NO: 477 | GACUGGCAGCCUCUGAACUAU | SEQ ID NO: 1120 | AGUUCAGAGGCCUGCCAGUCCA | SEQ ID NO: 1763 | GACUGGCAGCCUCUGAACU | 0.308 |
| AH0477 | SEQ ID NO: 478 | ACUGGCAGCCUCUGAACUAUG | SEQ ID NO: 1121 | UAGUUCAGAGCCUGCCAGUCC | SEQ ID NO: 1764 | ACUGGCAGCCUCUGAACUA | 0.177 |
| AH0478 | SEQ ID NO: 479 | CUGGCAGCCUCUGAACUAUGA | SEQ ID NO: 1122 | AUAGUUCAGAGCCUGCCAGUC | SEQ ID NO: 1765 | CUGGCAGCCUCUGAACUAU | 0.096 |
| AH0479 | SEQ ID NO: 480 | UGGCAGCCUCUGAACUAUGAA | SEQ ID NO: 1123 | CAUAGUUCAGAGCCUGCCAGU | SEQ ID NO: 1766 | UGGCAGCCUCUGAACUAUG | 0.306 |

TABLE 1 -continued

| Double stranded nucleic acid No. | SEQ ID NO: | Sense strand sequence (5'--->3') | SEQ ID NO: | Antisense strand sequence (5'--->3') | SEQ ID NO: | Target APCS mRNA sequence | APCS relative expression level |
|---|---|---|---|---|---|---|---|
| AH0480 | SEQ ID NO: 481 | GGCAGGCUCUGAACUAUGAAA | SEQ ID NO: 1124 | UCAUAGUUCAGAGCCUGCCAG | SEQ ID NO: 1767 | GGCAGGCUCUGAACUAUGA | 0.077 |
| AH0481 | SEQ ID NO: 482 | GCAGGCUCUGAACUAUGAAAU | SEQ ID NO: 1125 | UUCAUAGUUCAGAGCCUGCCA | SEQ ID NO: 1768 | GCAGGCUCUGAACUAUGAA | 0.406 |
| AH0482 | SEQ ID NO: 483 | CAGGCUCUGAACUAUGAAAUC | SEQ ID NO: 1126 | UUUCAUAGUUCAGAGCCUGCC | SEQ ID NO: 1769 | CAGGCUCUGAACUAUGAAA | 0.133 |
| AH0483 | SEQ ID NO: 484 | AGGCUCUGAACUAUGAAAUCA | SEQ ID NO: 1127 | AUUUCAUAGUUCAGAGCCUGC | SEQ ID NO: 1770 | AGGCUCUGAACUAUGAAAU | 0.137 |
| AH0484 | SEQ ID NO: 485 | GGCUCUGAACUAUGAAAUCAG | SEQ ID NO: 1128 | GAUUUCAUAGUUCAGAGCCUG | SEQ ID NO: 1771 | GGCUCUGAACUAUGAAAUC | 0.085 |
| AH0485 | SEQ ID NO: 486 | GCUCUGAACUAUGAAAUCAGA | SEQ ID NO: 1129 | UGAUUUCAUAGUUCAGAGCC | SEQ ID NO: 1772 | GCUCUGAACUAUGAAAUCA | 0.217 |
| AH0486 | SEQ ID NO: 487 | CUCUGAACUAUGAAAUCAGAG | SEQ ID NO: 1130 | CUGAUUUCAUAGUUCAGAGCC | SEQ ID NO: 1773 | CUCUGAACUAUGAAAUCAG | 0.197 |
| AH0487 | SEQ ID NO: 488 | UCUGAACUAUGAAAUCAGAGG | SEQ ID NO: 1131 | UCUGAUUUCAUAGUUCAGAGC | SEQ ID NO: 1774 | UCUGAACUAUGAAAUCAGA | 0.296 |
| AH0488 | SEQ ID NO: 489 | GAACUAUGAAAUCAGAGGAUA | SEQ ID NO: 1132 | UCCUCUGAUUUCAUAGUUCAG | SEQ ID NO: 1775 | GAACUAUGAAAUCAGAGGA | 0.128 |
| AH0489 | SEQ ID NO: 490 | AACUAUGAAAUCAGAGGAUAU | SEQ ID NO: 1133 | AUCCUCUGAUUUCAUAGUUCA | SEQ ID NO: 1776 | AACUAUGAAAUCAGAGGAU | 0.230 |
| AH0490 | SEQ ID NO: 491 | ACUAUGAAAUCAGAGGAUAUG | SEQ ID NO: 1134 | UAUCCUCUGAUUUCAUAGUU | SEQ ID NO: 1777 | ACUAUGAAAUCAGAGGAUA | 0.125 |
| AH0491 | SEQ ID NO: 492 | CUAUGAAAUCAGAGGAUAUGU | SEQ ID NO: 1135 | AUAUCCUCUGAUUUCAUAGU | SEQ ID NO: 1778 | CUAUGAAAUCAGAGGAUAU | 0.104 |
| AH0492 | SEQ ID NO: 493 | UAUGAAAUCAGAGGAUAUGUC | SEQ ID NO: 1136 | CAUAUCCUCUGAUUUCAUAGU | SEQ ID NO: 1779 | UAUGAAAUCAGAGGAUAUG | 0.330 |
| AH0493 | SEQ ID NO: 494 | UGAAAUCAGAGGAUAUGUCAU | SEQ ID NO: 1137 | GACAUAUCCUCUGAUUUCAUA | SEQ ID NO: 1780 | UGAAAUCAGAGGAUAUGUC | 0.338 |
| AH0494 | SEQ ID NO: 495 | GAAAUCAGAGGAUAUGUCAUC | SEQ ID NO: 1138 | UGACAUAUCCUCUGAUUUCAU | SEQ ID NO: 1781 | GAAAUCAGAGGAUAUGUCA | 0.043 |
| AH0495 | SEQ ID NO: 496 | AAAUCAGAGGAUAUGUCAUCA | SEQ ID NO: 1139 | AUGACAUAUCCUCUGAUUUCA | SEQ ID NO: 1782 | AAAUCAGAGGAUAUGUCAU | 0.084 |
| AH0496 | SEQ ID NO: 497 | AAUCAGAGGAUAUGUCAUCAU | SEQ ID NO: 1140 | GAUGACAUAUCCUCUGAUUUC | SEQ ID NO: 1783 | AAUCAGAGGAUAUGUCAUC | 0.489 |
| AH0497 | SEQ ID NO: 498 | CAGAGGAUAUGUCAUCAUCAA | SEQ ID NO: 1141 | GAUGAUGACAUAUCCUCUGAU | SEQ ID NO: 1784 | CAGAGGAUAUGUCAUCAUC | 0.142 |
| AH0498 | SEQ ID NO: 499 | AGAGGAUAUGUCAUCAUCAAA | SEQ ID NO: 1142 | UGAUGAUGACAUAUCCUCUGA | SEQ ID NO: 1785 | AGAGGAUAUGUCAUCAUCA | 0.079 |
| AH0499 | SEQ ID NO: 500 | GAGGAUAUGUCAUCAUCAAAC | SEQ ID NO: 1143 | UUGAUGAUGACAUAUCCUCUG | SEQ ID NO: 1786 | GAGGAUAUGUCAUCAUCAA | 0.079 |
| AH0500 | SEQ ID NO: 501 | AGGAUAUGUCAUCAUCAAACC | SEQ ID NO: 1144 | UUUGAUGAUGACAUAUCCUCU | SEQ ID NO: 1787 | AGGAUAUGUCAUCAUCAAA | 0.091 |
| AH0501 | SEQ ID NO: 502 | GGAUAUGUCAUCAUCAAACCC | SEQ ID NO: 1145 | GUUUGAUGAUGACAUAUCCUC | SEQ ID NO: 1788 | GGAUAUGUCAUCAUCAAAC | 0.062 |
| AH0502 | SEQ ID NO: 503 | GAUAUGUCAUCAUCAAACCCU | SEQ ID NO: 1146 | GGUUUGAUGAUGACAUAUCCU | SEQ ID NO: 1789 | GAUAUGUCAUCAUCAAACC | 0.343 |
| AH0503 | SEQ ID NO: 504 | AUGUCAUCAUCAAACCCUGG | SEQ ID NO: 1147 | AAGGGUUUGAUGAUGACAUAU | SEQ ID NO: 1790 | AUGUCAUCAUCAAACCCUU | 0.173 |

TABLE 1-continued

| Double stranded nucleic acid No. | SEQ ID NO: | Sense strand sequence (5'--->3') | SEQ ID NO: | Antisense strand sequence (5'--->3') | SEQ ID NO: | Target APCS mRNA sequence | APCS relative expression level |
|---|---|---|---|---|---|---|---|
| AH0504 | SEQ ID NO: 505 | CAUCAUCAAACCCUUGGUGUG | SEQ ID NO: 1148 | CACCAAGGGUUUGAUGAUGAC | SEQ ID NO: 1791 | CAUCAUCAAACCCUUGGUG | 0.442 |
| AH0505 | SEQ ID NO: 506 | UCAUCAAACCCUUGGUGUGG | SEQ ID NO: 1149 | CACACCAAGGGUUUGAUGAUG | SEQ ID NO: 1792 | UCAUCAAACCCUUGGUGUG | 0.355 |
| AH0506 | SEQ ID NO: 507 | ACCCUUGGUGUGGGUCUGAGG | SEQ ID NO: 1150 | UCAGACCCACACCAAGGGUUU | SEQ ID NO: 1793 | ACCCUUGGUGUGGGUCUGA | 0.393 |
| AH0507 | SEQ ID NO: 508 | CCCUUGGUGUGGGUCUGAGGU | SEQ ID NO: 1151 | CUCAGACCCACACCAAGGGUU | SEQ ID NO: 1794 | CCCUUGGUGUGGGUCUGAG | 0.273 |
| AH0508 | SEQ ID NO: 509 | CCUUGGUGUGGGUCUGAGGUC | SEQ ID NO: 1152 | CCUCAGACCCACACCAAGGGU | SEQ ID NO: 1795 | CCUUGGUGUGGGUCUGAGG | 0.137 |
| AH0509 | SEQ ID NO: 510 | CUUGGUGUGGGUCUGAGGUCU | SEQ ID NO: 1153 | ACCUCAGACCCACACCAAGGG | SEQ ID NO: 1796 | CUUGGUGUGGGUCUGAGGU | 0.220 |
| AH0510 | SEQ ID NO: 511 | UGGUGUGGGUCUGAGGUCUGA | SEQ ID NO: 1154 | AGACCUCAGACCCACACCAAG | SEQ ID NO: 1797 | UGGUGUGGGUCUGAGGUCU | 0.086 |
| AH0511 | SEQ ID NO: 512 | GGUGUGGGUCUGAGGUCUGAG | SEQ ID NO: 1155 | AAGACCUCAGACCCACACCAA | SEQ ID NO: 1798 | GGUGUGGGUCUGAGGUCUU | 0.125 |
| AH0512 | SEQ ID NO: 513 | GUGUGGGUCUGAGGUCUGAGG | SEQ ID NO: 1156 | CAAGACCUCAGACCCACACCA | SEQ ID NO: 1799 | GUGUGGGUCUGAGGUCUUG | 0.066 |
| AH0513 | SEQ ID NO: 514 | UGUGGGUCUGAGGUCUUGACU | SEQ ID NO: 1157 | UCAAGACCUCAGACCCACACC | SEQ ID NO: 1800 | UGUGGGUCUGAGGUCUUGA | 0.104 |
| AH0514 | SEQ ID NO: 515 | GUGGGUCUGAGGUCUUGACUC | SEQ ID NO: 1158 | GUCAAGACCUCAGACCCACAC | SEQ ID NO: 1801 | GUGGGUCUGAGGUCUUGAC | 0.098 |
| AH0515 | SEQ ID NO: 516 | GGGUCUGAGGUCUUGACUCAA | SEQ ID NO: 1159 | GAGUCAAGACCUCAGACCCAC | SEQ ID NO: 1802 | GGGUCUGAGGUCUUGACUC | 0.136 |
| AH0516 | SEQ ID NO: 517 | GGUCUGAGGUCUUGACUCAAC | SEQ ID NO: 1160 | UGAGUCAAGACCUCAGACCCA | SEQ ID NO: 1803 | GGUCUGAGGUCUUGACUCA | 0.072 |
| AH0517 | SEQ ID NO: 518 | GUCUGAGGUCUUGACUCAACG | SEQ ID NO: 1161 | UUGAGUCAAGACCUCAGACCC | SEQ ID NO: 1804 | GUCUGAGGUCUUGACUCAA | 0.146 |
| AH0518 | SEQ ID NO: 519 | CUGAGGUCUUGACUCAACGAG | SEQ ID NO: 1162 | CGUUGAGUCAAGACCUCAGAC | SEQ ID NO: 1805 | CUGAGGUCUUGACUCAACG | 0.241 |
| AH0519 | SEQ ID NO: 520 | UGAGGUCUUGACUCAACGAGA | SEQ ID NO: 1163 | UCGUUGAGUCAAGACCUCAGA | SEQ ID NO: 1806 | UGAGGUCUUGACUCAACGA | 0.087 |
| AH0520 | SEQ ID NO: 521 | GAGGUCUUGACUCAACGAGAG | SEQ ID NO: 1164 | CUCGUUGAGUCAAGACCUCAG | SEQ ID NO: 1807 | GAGGUCUUGACUCAACGAG | 0.096 |
| AH0521 | SEQ ID NO: 522 | AGGUCUUGACUCAACGAGAGC | SEQ ID NO: 1165 | UCUCGUUGAGUCAAGACCUCA | SEQ ID NO: 1808 | AGGUCUUGACUCAACGAGA | 0.069 |
| AH0522 | SEQ ID NO: 523 | GGUCUUGACUCAACGAGAGCA | SEQ ID NO: 1166 | CCUCGUUGAGUCAAGACCUC | SEQ ID NO: 1809 | GGUCUUGACUCAACGAGAG | 0.077 |
| AH0523 | SEQ ID NO: 524 | GUCUUGACUCAACGAGAGCAC | SEQ ID NO: 1167 | GCUCUCGUUGAGUCAAGACCU | SEQ ID NO: 1810 | GUCUUGACUCAACGAGAGC | 0.218 |
| AH0524 | SEQ ID NO: 525 | UCUUGACUCAACGAGAGCACU | SEQ ID NO: 1168 | UGCUCUCGUUGAGUCAAGACC | SEQ ID NO: 1811 | UCUUGACUCAACGAGAGCA | 0.125 |
| AH0525 | SEQ ID NO: 526 | CUUGACUCAACGAGAGCACUU | SEQ ID NO: 1169 | GUGCUCUCGUUGAGUCAAGAC | SEQ ID NO: 1812 | CUUGACUCAACGAGAGCAC | 0.195 |
| AH0526 | SEQ ID NO: 527 | UUGACUCAACGAGAGCACUUG | SEQ ID NO: 1170 | AGUGCUCUCGUUGAGUCAAGA | SEQ ID NO: 1813 | UUGACUCAACGAGAGCACU | 0.101 |
| AH0527 | SEQ ID NO: 528 | UGACUCAACGAGAGCACUUGA | SEQ ID NO: 1171 | AAGUGCUCUCGUUGAGUCAAG | SEQ ID NO: 1814 | UGACUCAACGAGAGCACUU | 0.189 |

TABLE 1-continued

| Double stranded nucleic acid No. | SEQ ID NO: | Sense strand sequence (5'--->3') | SEQ ID NO: | Antisense strand sequence (5'--->3') | SEQ ID NO: | Target APCS mRNA sequence | APCS relative expression level |
|---|---|---|---|---|---|---|---|
| AH0528 | SEQ ID NO: 529 | GACUCAACGAGAGCACUUGAA | SEQ ID NO: 1172 | CAAGUGCUCUCGUUGAGUCAA | SEQ ID NO: 1815 | GACUCAACGAGAGCACUUG | 0.090 |
| AH0529 | SEQ ID NO: 530 | ACUCAACGAGAGCACUUGAAA | SEQ ID NO: 1173 | UCAAGUGCUCUCGUUGAGUCA | SEQ ID NO: 1816 | ACUCAACGAGAGCACUUGA | 0.104 |
| AH0530 | SEQ ID NO: 531 | CUCAACGAGAGCACUUGAAAA | SEQ ID NO: 1174 | UUCAAGUGCUCUCGUUGAGUC | SEQ ID NO: 1817 | CUCAACGAGAGCACUUGAA | 0.107 |
| AH0531 | SEQ ID NO: 532 | UCAACGAGAGCACUUGAAAAU | SEQ ID NO: 1175 | UUUCAAGUGCUCUCGUUGAGU | SEQ ID NO: 1818 | UCAACGAGAGCACUUGAAA | 0.063 |
| AH0532 | SEQ ID NO: 533 | CAACGAGAGCACUUGAAAAUG | SEQ ID NO: 1176 | UUUUCAAGUGCUCUCGUUGAG | SEQ ID NO: 1819 | CAACGAGAGCACUUGAAAA | 0.066 |
| AH0533 | SEQ ID NO: 534 | AACGAGAGCACUUGAAAAUGA | SEQ ID NO: 1177 | AUUUUCAAGUGCUCUCGUUGA | SEQ ID NO: 1820 | AACGAGAGCACUUGAAAAU | 0.054 |
| AH0534 | SEQ ID NO: 535 | ACGAGAGCACUUGAAAAUGAA | SEQ ID NO: 1178 | CAUUUUCAAGUGCUCUCGUUG | SEQ ID NO: 1821 | ACGAGAGCACUUGAAAAUG | 0.073 |
| AH0535 | SEQ ID NO: 536 | CGAGAGCACUUGAAAAUGAAA | SEQ ID NO: 1179 | UCAUUUUCAAGUGCUCUCGUU | SEQ ID NO: 1822 | CGAGAGCACUUGAAAAUGA | 0.026 |
| AH0536 | SEQ ID NO: 537 | GAGAGCACUUGAAAAUGAAAU | SEQ ID NO: 1180 | UUUCAUUUUCAAGUGCUCUCG | SEQ ID NO: 1823 | GAGAGCACUUGAAAAUGAA | 0.031 |
| AH0537 | SEQ ID NO: 538 | AGAGCACUUGAAAAUGAAAUG | SEQ ID NO: 1181 | UUUUCAUUUUCAAGUGCUCUC | SEQ ID NO: 1824 | AGAGCACUUGAAAAUGAAA | 0.059 |
| AH0538 | SEQ ID NO: 539 | GAGCACUUGAAAAUGAAAUGA | SEQ ID NO: 1182 | AUUUCAUUUUCAAGUGCUCUC | SEQ ID NO: 1825 | GAGCACUUGAAAAUGAAAU | 0.054 |
| AH0539 | SEQ ID NO: 540 | AGCACUUGAAAAUGAAAUGAC | SEQ ID NO: 1183 | CAUUUCAUUUUCAAGUGCUCU | SEQ ID NO: 1826 | AGCACUUGAAAAUGAAAUG | 0.032 |
| AH0540 | SEQ ID NO: 541 | GCACUUGAAAAUGAAAUGACU | SEQ ID NO: 1184 | UCAUUUCAUUUUCAAGUGCUC | SEQ ID NO: 1827 | GCACUUGAAAAUGAAAUGA | 0.074 |
| AH0541 | SEQ ID NO: 542 | CACUUGAAAAUGAAAUGACUG | SEQ ID NO: 1185 | GUCAUUUCAUUUUCAAGUGCU | SEQ ID NO: 1828 | CACUUGAAAAUGAAAUGAC | 0.204 |
| AH0542 | SEQ ID NO: 543 | ACUUGAAAAUGAAAUGACUGU | SEQ ID NO: 1186 | AGUCAUUUCAUUUUCAAGUGC | SEQ ID NO: 1829 | ACUUGAAAAUGAAAUGACU | 0.103 |
| AH0543 | SEQ ID NO: 544 | CUUGAAAAUGAAAUGACUGUC | SEQ ID NO: 1187 | CAGUCAUUUCAUUUUCAAGUG | SEQ ID NO: 1830 | CUUGAAAAUGAAAUGACUG | 0.121 |
| AH0544 | SEQ ID NO: 545 | UUGAAAAUGAAAUGACUGUCU | SEQ ID NO: 1188 | ACAGUCAUUUCAUUUUCAAGU | SEQ ID NO: 1831 | UUGAAAAUGAAAUGACUGU | 0.201 |
| AH0545 | SEQ ID NO: 546 | UGAAAAUGAAAUGACUGUCUA | SEQ ID NO: 1189 | GACAGUCAUUUCAUUUUCAAG | SEQ ID NO: 1832 | UGAAAAUGAAAUGACUGUC | 0.445 |
| AH0546 | SEQ ID NO: 547 | GAAAAUGAAAUGACUGUCUAA | SEQ ID NO: 1190 | AGACAGUCAUUUCAUUUUCAA | SEQ ID NO: 1833 | GAAAAUGAAAUGACUGUCU | 0.068 |
| AH0547 | SEQ ID NO: 548 | AAAAUGAAAUGACUGUCUAAG | SEQ ID NO: 1191 | UAGACAGUCAUUUCAUUUUCA | SEQ ID NO: 1834 | AAAAUGAAAUGACUGUCUA | 0.053 |
| AH0548 | SEQ ID NO: 549 | AAAUGAAAUGACUGUCUAAGA | SEQ ID NO: 1192 | UUAGACAGUCAUUUCAUUUUC | SEQ ID NO: 1835 | AAAUGAAAUGACUGUCUAA | 0.073 |
| AH0549 | SEQ ID NO: 550 | AAUGAAAUGACUGUCUAAGAA | SEQ ID NO: 1193 | CUUAGACAGUCAUUUCAUUUU | SEQ ID NO: 1836 | AAUGAAAUGACUGUCUAAG | 0.365 |
| AH0550 | SEQ ID NO: 551 | AUGAAAUGACUGUCUAAGAGA | SEQ ID NO: 1194 | UCUUAGACAGUCAUUUCAUUU | SEQ ID NO: 1837 | AUGAAAUGACUGUCUAAGA | 0.395 |
| AH0551 | SEQ ID NO: 552 | UGAAAUGACUGUCUAAGAGAU | SEQ ID NO: 1195 | CUCUUAGACAGUCAUUUCAUU | SEQ ID NO: 1838 | UGAAAUGACUGUCUAAGAG | 0.471 |

TABLE 1-continued

| Double stranded nucleic acid No. | Sense strand sequence (5'--->3') | SEQ ID NO: | Antisense strand sequence (5'--->3') | SEQ ID NO: | Target APCS mRNA sequence | APCS relative expression level |
|---|---|---|---|---|---|---|
| AH0552 | GAAAUGACUGUCUAAGAGAUC | SEQ ID NO: 553 | UCUCUUAGACAGUCAUUUCAU | SEQ ID NO: 1196 | GAAAUGACUGUCUAAGAGA | 0.077 |
| AH0553 | AAAUGACUGUCUAAGAGAUCU | SEQ ID NO: 554 | AUCUCUUAGACAGUCAUUUCA | SEQ ID NO: 1197 | AAAUGACUGUCUAAGAGAU | 0.161 |
| AH0554 | AUGACUGUCUAAGAGAUCUGG | SEQ ID NO: 555 | AGAUCUCUUAGACAGUCAUUU | SEQ ID NO: 1198 | AUGACUGUCUAAGAGAUCU | 0.244 |
| AH0555 | UGACUGUCUAAGAGAUCUGGU | SEQ ID NO: 556 | CAGAUCUCUUAGACAGUCAUU | SEQ ID NO: 1199 | UGACUGUCUAAGAGAUCUG | 0.390 |
| AH0556 | GACUGUCUAAGAGAUCUGGUC | SEQ ID NO: 557 | CCAGAUCUCUUAGACAGUCAU | SEQ ID NO: 1200 | GACUGUCUAAGAGAUCUGG | 0.143 |
| AH0557 | ACUGUCUAAGAGAUCUGGUCA | SEQ ID NO: 558 | ACCAGAUCUCUUAGACAGUCA | SEQ ID NO: 1201 | ACUGUCUAAGAGAUCUGGU | 0.202 |
| AH0558 | CUGUCUAAGAGAUCUGGUCAA | SEQ ID NO: 559 | GACCAGAUCUCUUAGACAGUC | SEQ ID NO: 1202 | CUGUCUAAGAGAUCUGGUC | 0.119 |
| AH0559 | UGUCUAAGAGAUCUGGUCAAA | SEQ ID NO: 560 | UGACCAGAUCUCUUAGACAGU | SEQ ID NO: 1203 | UGUCUAAGAGAUCUGGUCA | 0.121 |
| AH0560 | GUCUAAGAGAUCUGGUCAAAG | SEQ ID NO: 561 | UUGACCAGAUCUCUUAGACAG | SEQ ID NO: 1204 | GUCUAAGAGAUCUGGUCAA | 0.053 |
| AH0561 | UCUAAGAGAUCUGGUCAAAGC | SEQ ID NO: 562 | UUUGACCAGAUCUCUUAGACA | SEQ ID NO: 1205 | UCUAAGAGAUCUGGUCAAA | 0.081 |
| AH0562 | CUAAGAGAUCUGGUCAAAGCA | SEQ ID NO: 563 | CUUUGACCAGAUCUCUUAGAC | SEQ ID NO: 1206 | CUAAGAGAUCUGGUCAAAG | 0.051 |
| AH0563 | UAAGAGAUCUGGUCAAAGCAA | SEQ ID NO: 564 | GCUUUGACCAGAUCUCUUAGA | SEQ ID NO: 1207 | UAAGAGAUCUGGUCAAAGC | 0.363 |
| AH0564 | AAGAGAUCUGGUCAAAGCAAC | SEQ ID NO: 565 | UGCUUUGACCAGAUCUCUUAG | SEQ ID NO: 1208 | AAGAGAUCUGGUCAAAGCA | 0.053 |
| AH0565 | AGAGAUCUGGUCAAAGCAACU | SEQ ID NO: 566 | UUGCUUUGACCAGAUCUCUUA | SEQ ID NO: 1209 | AGAGAUCUGGUCAAAGCAA | 0.091 |
| AH0566 | GAGAUCUGGUCAAAGCAACUG | SEQ ID NO: 567 | GUUGCUUUGACCAGAUCUCUU | SEQ ID NO: 1210 | GAGAUCUGGUCAAAGCAAC | 0.074 |
| AH0567 | AGAUCUGGUCAAAGCAACUGG | SEQ ID NO: 568 | AGUUGCUUUGACCAGAUCUCU | SEQ ID NO: 1211 | AGAUCUGGUCAAAGCAACU | 0.096 |
| AH0568 | GAUCUGGUCAAAGCAACUGGA | SEQ ID NO: 569 | CAGUUGCUUUGACCAGAUCUC | SEQ ID NO: 1212 | GAUCUGGUCAAAGCAACUG | 0.118 |
| AH0569 | AUCUGGUCAAAGCAACUGGAU | SEQ ID NO: 570 | CCAGUUGCUUUGACCAGAUCU | SEQ ID NO: 1213 | AUCUGGUCAAAGCAACUGG | 0.225 |
| AH0570 | UCUGGUCAAAGCAACUGGAUA | SEQ ID NO: 571 | UCCAGUUGCUUUGACCAGAUC | SEQ ID NO: 1214 | UCUGGUCAAAGCAACUGGA | 0.105 |
| AH0571 | CUGGUCAAAGCAACUGGAUAC | SEQ ID NO: 572 | AUCCAGUUGCUUUGACCAGAU | SEQ ID NO: 1215 | CUGGUCAAAGCAACUGGAU | 0.160 |
| AH0572 | UGGUCAAAGCAACUGGAUACU | SEQ ID NO: 573 | UAUCCAGUUGCUUUGACCAGA | SEQ ID NO: 1216 | UGGUCAAAGCAACUGGAUA | 0.093 |
| AH0573 | GGUCAAAGCAACUGGAUACUA | SEQ ID NO: 574 | GUAUCCAGUUGCUUUGACCAG | SEQ ID NO: 1217 | GGUCAAAGCAACUGGAUAC | 0.118 |
| AH0574 | GUCAAAGCAACUGGAUACUAG | SEQ ID NO: 575 | AGUAUCCAGUUGCUUUGACCA | SEQ ID NO: 1218 | GUCAAAGCAACUGGAUACU | 0.131 |
| AH0575 | UCAAAGCAACUGGAUACUAGA | SEQ ID NO: 576 | UAGUAUCCAGUUGCUUUGACC | SEQ ID NO: 1219 | UCAAAGCAACUGGAUACUA | 0.094 |

TABLE 1 -continued

| Double stranded nucleic acid No. | Sense strand sequence (5'--->3') | SEQ ID NO: | Antisense strand sequence (5'--->3') | SEQ ID NO: | Target APCS mRNA sequence | APCS relative expression level |
|---|---|---|---|---|---|---|
| AH0576 | CAAAGCAACUGGAUACUAGAU | SEQ ID NO: 577 | CUAGUAUCCAGUUGCUUUGAC | SEQ ID NO: 1220 | CAAAGCAACUGGAUACUAG | 0.122 |
| AH0577 | AAAGCAACUGGAUACUAGAUC | SEQ ID NO: 578 | UCUAGUAUCCAGUUGCUUUGA | SEQ ID NO: 1221 | AAAGCAACUGGAUACUAGA | 0.089 |
| AH0578 | AAGCAACUGGAUACUAGAUCU | SEQ ID NO: 579 | AUCUAGUAUCCAGUUGCUUUG | SEQ ID NO: 1222 | AAGCAACUGGAUACUAGAU | 0.156 |
| AH0579 | AGCAACUGGAUACUAGAUCUU | SEQ ID NO: 580 | GAUCUAGUAUCCAGUUGCUUU | SEQ ID NO: 1223 | AGCAACUGGAUACUAGAUC | 0.248 |
| AH0580 | GCAACUGGAUACUAGAUCUUA | SEQ ID NO: 581 | AGAUCUAGUAUCCAGUUGCUU | SEQ ID NO: 1224 | GCAACUGGAUACUAGAUCU | 0.089 |
| AH0581 | CAACUGGAUACUAGAUCUUAC | SEQ ID NO: 582 | AAGAUCUAGUAUCCAGUUGCU | SEQ ID NO: 1225 | CAACUGGAUACUAGAUCUU | 0.067 |
| AH0582 | AACUGGAUACUAGAUCUUACA | SEQ ID NO: 583 | UAAGAUCUAGUAUCCAGUUGC | SEQ ID NO: 1226 | AACUGGAUACUAGAUCUUA | 0.101 |
| AH0583 | ACUGGAUACUAGAUCUUACAU | SEQ ID NO: 584 | GUAAGAUCUAGUAUCCAGUUG | SEQ ID NO: 1227 | ACUGGAUACUAGAUCUUAC | 0.096 |
| AH0584 | CUGGAUACUAGAUCUUACAUC | SEQ ID NO: 585 | UGUAAGAUCUAGUAUCCAGUU | SEQ ID NO: 1228 | CUGGAUACUAGAUCUUACA | 0.075 |
| AH0585 | UGGAUACUAGAUCUUACAUCU | SEQ ID NO: 586 | AUGUAAGAUCUAGUAUCCAGU | SEQ ID NO: 1229 | UGGAUACUAGAUCUUACAU | 0.115 |
| AH0586 | GGAUACUAGAUCUUACAUCUG | SEQ ID NO: 587 | GAUGUAAGAUCUAGUAUCCAG | SEQ ID NO: 1230 | GGAUACUAGAUCUUACACU | 0.087 |
| AH0587 | GAUACUAGAUCUUACAUCUGC | SEQ ID NO: 588 | AGAUGUAAGAUCUAGUAUCCA | SEQ ID NO: 1231 | GAUACUAGAUCUUACAUCU | 0.069 |
| AH0588 | AUACUAGAUCUUACAUCUGCA | SEQ ID NO: 589 | CAGAUGUAAGAUCUAGUAUCC | SEQ ID NO: 1232 | AUACUAGAUCUUACAUCUG | 0.105 |
| AH0589 | ACUAGAUCUUACAUCUGCAGC | SEQ ID NO: 590 | UGCAGAUGUAAGAUCUAGUAU | SEQ ID NO: 1233 | ACUAGAUCUUACAUCUGCA | 0.069 |
| AH0590 | CUAGAUCUUACAUCUGCAGCU | SEQ ID NO: 591 | CUGCAGAUGUAAGAUCUAGUA | SEQ ID NO: 1234 | CUAGAUCUUACAUCUGCAG | 0.091 |
| AH0591 | AGAUCUUACAUCUGCAGCUCU | SEQ ID NO: 592 | AGCUGCAGAUGUAAGAUCUAG | SEQ ID NO: 1235 | AGAUCUUACAUCUGCAGCU | 0.112 |
| AH0592 | GAUCUUACAUCUGCAGCUCUC | SEQ ID NO: 593 | GAGCUGCAGAUGUAAGAUCUA | SEQ ID NO: 1236 | GAUCUUACAUCUGCAGCUC | 0.096 |
| AH0593 | AUCUUACAUCUGCAGCUCUCU | SEQ ID NO: 594 | AGAGCUGCAGAUGUAAGAUCU | SEQ ID NO: 1237 | AUCUUACAUCUGCAGCUCU | 0.089 |
| AH0594 | UCUUACAUCUGCAGCUCUCUU | SEQ ID NO: 595 | AAGAGCUGCAGAUGUAAGAUC | SEQ ID NO: 1238 | UCUUACAUCUGCAGCUCUU | 0.083 |
| AH0595 | CUUACAUCUGCAGCUCUCUUU | SEQ ID NO: 596 | AAAGAGCUGCAGAUGUAAGAU | SEQ ID NO: 1239 | CUUACAUCUGCAGCUCUUU | 0.058 |
| AH0596 | UUACAUCUGCAGCUCUCUUUC | SEQ ID NO: 597 | GAAAGAGCUGCAGAUGUAAGA | SEQ ID NO: 1240 | UUACAUCUGCAGCUCUUUC | 0.110 |
| AH0597 | UACAUCUGCAGCUCUCUUUCU | SEQ ID NO: 598 | AGAAAGAGCUGCAGAUGUAAG | SEQ ID NO: 1241 | UACAUCUGCAGCUCUUUCU | 0.168 |
| AH0598 | ACAUCUGCAGCUCUCUUUCUC | SEQ ID NO: 599 | AAGAAAGAGCUGCAGAUGUAA | SEQ ID NO: 1242 | ACAUCUGCAGCUCUCUUU | 0.083 |
| AH0599 | CAUCUGCAGCUCUCUUUCUCU | SEQ ID NO: 600 | GAAGAAAGAGCUGCAGAUGUA | SEQ ID NO: 1243 | CAUCUGCAGCUCUUUCUUC | 0.072 |

TABLE 1-continued

| Double stranded nucleic acid No. | Sense strand sequence (5'--->3') | SEQ ID NO: | Antisense strand sequence (5'--->3') | SEQ ID NO: | Target APCS mRNA sequence | SEQ ID NO: | APCS relative expression level |
|---|---|---|---|---|---|---|---|
| AH0600 | AUCUGCAGCUCUUUCUUCUUU | SEQ ID NO: 601 | AGAAGAAAGAGCUGCAGAUGU | SEQ ID NO: 1244 | AUCUGCAGCUCUUUCUUCU | SEQ ID NO: 1887 | 0.072 |
| AH0601 | UCUGCAGCUCUUUCUUCUUUG | SEQ ID NO: 602 | AAAGAAGAAAGAGCUGCAGAUG | SEQ ID NO: 1245 | UCUGCAGCUCUUUCUUCUU | SEQ ID NO: 1888 | 0.086 |
| AH0602 | CUGCAGCUCUUUCUUCUUUGA | SEQ ID NO: 603 | AAAGAAGAAAGAGCUGCAGAU | SEQ ID NO: 1246 | CUGCAGCUCUUUCUUCUUU | SEQ ID NO: 1889 | 0.097 |
| AH0603 | UGCAGCUCUUUCUUCUUUGAA | SEQ ID NO: 604 | CAAAGAAGAAAGAGCUGCAGA | SEQ ID NO: 1247 | UGCAGCUCUUUCUUCUUUG | SEQ ID NO: 1890 | 0.096 |
| AH0604 | GCAGCUCUUUCUUCUUUGAAU | SEQ ID NO: 605 | UCAAAGAAGAAAGAGCUGCAG | SEQ ID NO: 1248 | GCAGCUCUUUCUUCUUUGA | SEQ ID NO: 1891 | 0.059 |
| AH0605 | CAGCUCUUUCUUCUUUGAAUU | SEQ ID NO: 606 | UUCAAAGAAGAAAGAGCUGCA | SEQ ID NO: 1249 | CAGCUCUUUCUUCUUUGAA | SEQ ID NO: 1892 | 0.054 |
| AH0606 | AGCUCUUUCUUCUUUGAAUUU | SEQ ID NO: 607 | AUUCAAAGAAGAAAGAGCUGC | SEQ ID NO: 1250 | AGCUCUUUCUUCUUUGAAU | SEQ ID NO: 1893 | 0.053 |
| AH0607 | GCUCUUUCUUCUUUGAAUUUC | SEQ ID NO: 608 | AAUUCAAAGAAGAAAGAGCUG | SEQ ID NO: 1251 | GCUCUUUCUUCUUUGAAUU | SEQ ID NO: 1894 | 0.057 |
| AH0608 | CUCUUUCUUCUUUGAAUUUCC | SEQ ID NO: 609 | GAAAUUCAAAGAAGAAAGAGC | SEQ ID NO: 1252 | CUCUUUCUUCUUUGAAUUU | SEQ ID NO: 1895 | 0.068 |
| AH0609 | UCUUUCUUCUUUGAAUUUCCU | SEQ ID NO: 610 | AGGAAAUUCAAAGAAGAAAGAG | SEQ ID NO: 1253 | UCUUUCUUCUUUGAAUUUC | SEQ ID NO: 1896 | 0.184 |
| AH0610 | CUUUCUUCUUUGAAUUUCCUA | SEQ ID NO: 611 | UAGGAAAUUCAAAGAAGAAAGA | SEQ ID NO: 1254 | CUUUCUUCUUUGAAUUUCC | SEQ ID NO: 1897 | 0.079 |
| AH0611 | UUUCUUCUUUGAAUUUCCUAU | SEQ ID NO: 612 | AUAGGAAAUUCAAAGAAGAAA | SEQ ID NO: 1255 | UUUCUUCUUUGAAUUUCCU | SEQ ID NO: 1898 | 0.124 |
| AH0612 | UUCUUCUUUGAAUUUCCUAUC | SEQ ID NO: 613 | GAUAGGAAAUUCAAAGAAGAA | SEQ ID NO: 1256 | UUCUUCUUUGAAUUUCCUA | SEQ ID NO: 1899 | 0.212 |
| AH0613 | UCUUCUUUGAAUUUCCUAUCU | SEQ ID NO: 614 | AGAUAGGAAAUUCAAAGAAGA | SEQ ID NO: 1257 | UCUUCUUUGAAUUUCCUAU | SEQ ID NO: 1900 | 0.259 |
| AH0614 | CUUCUUUGAAUUUCCUAUCUG | SEQ ID NO: 615 | CAGAUAGGAAAUUCAAAGAAG | SEQ ID NO: 1258 | CUUCUUUGAAUUUCCUAUC | SEQ ID NO: 1901 | 0.171 |
| AH0615 | UUCUUUGAAUUUCCUAUCUGU | SEQ ID NO: 616 | ACAGAUAGGAAAUUCAAAGAA | SEQ ID NO: 1259 | UUCUUUGAAUUUCCUAUCU | SEQ ID NO: 1902 | 0.194 |
| AH0616 | UCUUUGAAUUUCCUAUCUGUA | SEQ ID NO: 617 | UACAGAUAGGAAAUUCAAAGA | SEQ ID NO: 1260 | UCUUUGAAUUUCCUAUCUG | SEQ ID NO: 1903 | 0.073 |
| AH0617 | CUUUGAAUUUCCUAUCUGUAU | SEQ ID NO: 618 | AUACAGAUAGGAAAUUCAAAG | SEQ ID NO: 1261 | CUUUGAAUUUCCUAUCUGU | SEQ ID NO: 1904 | 0.072 |
| AH0618 | UUUGAAUUUCCUAUCUGUAUG | SEQ ID NO: 619 | CAUACAGAUAGGAAAUUCAAA | SEQ ID NO: 1262 | UUUGAAUUUCCUAUCUGUA | SEQ ID NO: 1905 | 0.104 |
| AH0619 | UUGAAUUUCCUAUCUGUAUGU | SEQ ID NO: 620 | ACAUACAGAUAGGAAAUUCAA | SEQ ID NO: 1263 | UUGAAUUUCCUAUCUGUAU | SEQ ID NO: 1906 | 0.151 |
| AH0620 | UGAAUUUCCUAUCUGUAUGUC | SEQ ID NO: 621 | ACAUACAGAUAGGAAAUUCAA | SEQ ID NO: 1264 | UGAAUUUCCUAUCUGUAUG | SEQ ID NO: 1907 | 0.066 |
| AH0621 | GAAUUUCCUAUCUGUAUGUCU | SEQ ID NO: 622 | AGACAUACAGAUAGGAAAUUC | SEQ ID NO: 1265 | GAAUUUCCUAUCUGUAUGU | SEQ ID NO: 1908 | 0.280 |
| AH0622 | AAUUUCCUAUCUGUAUGUCUG | SEQ ID NO: 623 | CAGACAUACAGAUAGGAAAUU | SEQ ID NO: 1266 | AUUUCCUAUCUGUAUGUCU | SEQ ID NO: 1909 | 0.222 |
| AH0623 | UUUCCUAUCUGUAUGUCUGCC | SEQ ID NO: 624 | GCAGACAUACAGAUAGGAAAU | SEQ ID NO: 1267 | UUCCUAUCUGUAUGUCUGC | SEQ ID NO: 1910 | 0.474 |

TABLE 1 -continued

| Double stranded nucleic acid No. | SEQ ID NO: | Sense strand sequence (5'--->3') | SEQ ID NO: | Antisense strand sequence (5'--->3') | SEQ ID NO: | Target APCS mRNA sequence | APCS relative expression level |
|---|---|---|---|---|---|---|---|
| AH0624 | SEQ ID NO: 625 | UCCUAUCUGUAUGUCUGCCUA | SEQ ID NO: 1268 | GGCAGACAUACAGAUAGGAAA | SEQ ID NO: 1911 | UCCUAUCUGUAUGUCUGCC | 0.494 |
| AH0625 | SEQ ID NO: 626 | CCUAUCUGUAUGUCUGCCUAA | SEQ ID NO: 1269 | AGGCAGACAUACAGAUAGGAA | SEQ ID NO: 1912 | CCUAUCUGUAUGUCUGCCU | 0.088 |
| AH0626 | SEQ ID NO: 627 | CUAUCUGUAUGUCUGCCUAAU | SEQ ID NO: 1270 | UAGGCAGACAUACAGAUAGGA | SEQ ID NO: 1913 | CUAUCUGUAUGUCUGCCUA | 0.073 |
| AH0627 | SEQ ID NO: 628 | UAUCUGUAUGUCUGCCUAAUU | SEQ ID NO: 1271 | UUAGGCAGACAUACAGAUAGG | SEQ ID NO: 1914 | UAUCUGUAUGUCUGCCUAA | 0.114 |
| AH0628 | SEQ ID NO: 629 | AUCUGUAUGUCUGCCUAAUUA | SEQ ID NO: 1272 | AUUAGGCAGACAUACAGAUAG | SEQ ID NO: 1915 | AUCUGUAUGUCUGCCUAAU | 0.073 |
| AH0629 | SEQ ID NO: 630 | UCUGUAUGUCUGCCUAAUUAA | SEQ ID NO: 1273 | AAUUAGGCAGACAUACAGAUA | SEQ ID NO: 1916 | UCUGUAUGUCUGCCUAAUU | 0.132 |
| AH0630 | SEQ ID NO: 631 | CUGUAUGUCUGCCUAAUUAAA | SEQ ID NO: 1274 | UAAUUAGGCAGACAUACAGAU | SEQ ID NO: 1917 | CUGUAUGUCUGCCUAAUUA | 0.051 |
| AH0631 | SEQ ID NO: 632 | UGUAUGUCUGCCUAAUUAAAA | SEQ ID NO: 1275 | UUAAUUAGGCAGACAUACAGA | SEQ ID NO: 1918 | UGUAUGUCUGCCUAAUUAA | 0.109 |
| AH0632 | SEQ ID NO: 633 | GUAUGUCUGCCUAAUUAAAAA | SEQ ID NO: 1276 | UUUAAUUAGGCAGACAUACAG | SEQ ID NO: 1919 | GUAUGUCUGCCUAAUUAAA | 0.091 |
| AH0633 | SEQ ID NO: 634 | UAUGUCUGCCUAAUUAAAAAA | SEQ ID NO: 1277 | UUUUAAUUAGGCAGACAUACA | SEQ ID NO: 1920 | UAUGUCUGCCUAAUUAAAA | 0.083 |
| AH0634 | SEQ ID NO: 635 | AUGUCUGCCUAAUUAAAAAAA | SEQ ID NO: 1278 | UUUUUAAUUAGGCAGACAUAC | SEQ ID NO: 1921 | AUGUCUGCCUAAUUAAAAA | 0.081 |
| AH0635 | SEQ ID NO: 636 | UGUCUGCCUAAUUAAAAAAAU | SEQ ID NO: 1279 | AUUUUUUAAUUAGGCAGACAUA | SEQ ID NO: 1922 | UGUCUGCCUAAUUAAAAAA | 0.113 |
| AH0636 | SEQ ID NO: 637 | GUCUGCCUAAUUAAAAAAAUA | SEQ ID NO: 1280 | UAUUUUUUAAUUAGGCAGACAU | SEQ ID NO: 1923 | GUCUGCCUAAUUAAAAAAA | 0.179 |
| AH0637 | SEQ ID NO: 638 | UCUGCCUAAUUAAAAAAAUAU | SEQ ID NO: 1281 | AUAUUUUUUAAUUAGGCAGACA | SEQ ID NO: 1924 | UCUGCCUAAUUAAAAAAAU | 0.113 |
| AH0638 | SEQ ID NO: 639 | CUGCCUAAUUAAAAAAAUAUA | SEQ ID NO: 1282 | UAUAUUUUUUAAUUAGGCAGAC | SEQ ID NO: 1925 | CUGCCUAAUUAAAAAAAUA | 0.043 |
| AH0639 | SEQ ID NO: 640 | UGCCUAAUUAAAAAAAUAUAU | SEQ ID NO: 1283 | AUAUAUUUUUUAAUUAGGCAGA | SEQ ID NO: 1926 | UGCCUAAUUAAAAAAAUAU | 0.151 |
| AH0640 | SEQ ID NO: 641 | GCCUAAUUAAAAAAAUAUAUA | SEQ ID NO: 1284 | UAUAUAUUUUUUAAUUAGGCAG | SEQ ID NO: 1927 | GCCUAAUUAAAAAAAUAUA | 0.191 |
| AH0641 | SEQ ID NO: 642 | CCUAAUUAAAAAAAUAUAUAU | SEQ ID NO: 1285 | AUAUAUAUUUUUUAAUUAGGCA | SEQ ID NO: 1928 | CCUAAUUAAAAAAAUAUAU | 0.361 |
| AH0642 | SEQ ID NO: 643 | CUAAUUAAAAAAAUAUAUAUU | SEQ ID NO: 1286 | UAUAUAUAUUUUUUAAUUAGGC | SEQ ID NO: 1929 | CUAAUUAAAAAAAUAUAUA | 0.287 |
| AH0643 | SEQ ID NO: 644 | UAAAAAAAUAUAUAUUGUAUU | SEQ ID NO: 1287 | UACAAUAUAUAUUUUUUUAAU | SEQ ID NO: 1930 | UAAAAAAAUAUAUAUUGUA | 0.376 |

Note that, the full length base sequence of the 2nd strand cDNA of APCS is shown in Table 2.

TABLE 2

| SEQ ID NO: 1 | gggcatgaatatcagacgctaggggacagccactgtgttgtctgc<br>taccctcatcctggtcactgcttctgctataacagccctaggccag<br>gaatatgaacaagccgctgctttggatctctgtcctcaccagcctc<br>ctggaagcctttgctcacacagacctcagtgggaaggtgtttgtat<br>ttcctagagaatctgttactgatcatgtaaacttgatcacaccgct<br>ggagaagcctctacagaactttaccttgtgttttcgagcctatagt<br>gatctctctcgtgcctacagcctcttctcctacaatacccaaggca<br>gggataatgagctactagtttataaagaaagagttggagagtatag<br>tctatacattggaagacacaaagttacatccaaagttatcgaaaag<br>ttcccggctccagtgcacatctgtgtgagctgggagtcctcatcag<br>gtattgctgaattttggatcaatgggacacctttggtgaaaaaggg<br>tctgcgacagggttactttgtagaagctcagcccaagattgtcctg<br>gggcaggaacaggattcctatgggggcaagtttgataggagccagt<br>cctttgtgggagagattgggatttgtacatgtgggactctgtgct<br>gccccagaaaatatcctgtctgcctatcagggtaccoctctccct<br>gccaatatcctggactggcaggctctgaactatgaaatcagaggat<br>atgtcatcatcaaaccccttggtgtgggtctgaggtcttgactcaac<br>gagagcacttgaaaatgaaatgactgtctaagagatctggtcaaag<br>caactggatactagatcttacatctgcagctctttcttctttgaat<br>ttcctatctgtatgtctgcctaattaaaaaaatatatattgtatta<br>tgctacctgcaaaaaaaaaaaaaaaaaaaaaaaaaaaaa |

Example 3 Knockdown Activity of Chemically Modified Double-Stranded Nucleic Acid Synthesis of sense-strand nucleic acids consisting of ribonucleotides represented by SEQ ID NOs: 1931 to 1974, and antisense-strand nucleic acids consisting of ribonucleotides represented by SEQ ID NOs: 1975 to 2018 were outsourced to Gene Design, Inc., and double-stranded nucleic acids were prepared by annealing them (sense-strands represented by SEQ ID NO: n (n=1931 to 1974) and the antisense-strands represented by SEQ ID NO: [n+44] are paired).

The final concentration of each of the double-stranded nucleic acids that was synthesized was set at 1 nM or 0.1 nM. The same operation as in Example 2 was repeated except that each of the double-stranded nucleic acids was introduced in RMG-1 cells and culture was carried out for 24 hours. The relative expression levels of APCS mRNAs were calculated. This experiment was repeated 4 times and median values of the relative expression levels of APCS mRNAs are shown in Table 3. In Table 3, N(M) represents 2'-O-methyl-RNA and N(F) represents 2'-F-RNA, wherein N represents A, C, G or U. For convenience sake, Table 3 will be separately shown as follows.

TABLE 3

| Double stranded nucleic acid No. | SEQ ID NO: | Sense strand sequence (5'--->3') | SEQ ID NO: | Antisense strand sequence (5'--->3') | APCS relative expression level (1 nM) | APCS relative expression level (0.1 nM) |
|---|---|---|---|---|---|---|
| AH0644 | SEQ ID NO: 1931 | U(F)A(M)C(F)C(M)U(F)U(M)G(F)U(M)G(F)U(M)U(F)U(F)G(M)A(F)C(M)G(F)G(M)C(F)C(M)U(F)A(M) | SEQ ID NO: 1975 | U(F)A(M)G(F)G(M)C(F)C(M)G(F)U(M)C(F)A(M)A(F)A(M)C(F)A(M)C(M)A(F)A(M)G(F)G(M)U(F)A(M)A(F)A(M) | 0.057 | 0.098 |
| AH0645 | SEQ ID NO: 1932 | U(F)C(M)C(F)U(M)U(F)A(M)C(F)A(M)G(F)C(M)C(F)U(M)C(F)U(M)C(F)A(M)C | SEQ ID NO: 1976 | U(F)A(M)G(F)G(M)C(F)G(M)A(F)G(M)G(F)C(M)U(F)G(M)U(F)A(M)A(F)G(M)G(F)A(M)G(F)G(M)A(F)G(M)G(F)G(M) | 0.083 | 0.130 |
| AH0646 | SEQ ID NO: 1933 | A(F)C(M)A(F)G(M)C(F)C(M)U(F)C(M)U(F)C(M)U(F)C(M)U(F)U(M)C | SEQ ID NO: 1977 | U(F)A(M)U(F)G(M)G(F)A(M)A(F)G(M)A(F)G(M)A(F)G(M)G(F)C(M)U(F)G(M)U(F)A(M)A(F)G(M)G(F)G(M) | 0.101 | 0.257 |
| AH0647 | SEQ ID NO: 1934 | G(F)U(M)C(F)C(M)U(F)U(M)A(F)U(M)U(F)C(M)A(F)A(M)G | SEQ ID NO: 1978 | U(F)C(M)A(F)C(M)C(F)U(M)U(F)G(M)A(F)A(M)U(F)A(M)A(F)G(M)G(F)A(M)C(M)U(F)C(F)A(M)U | 0.135 | 0.293 |
| AH0648 | SEQ ID NO: 1935 | A(F)G(M)G(F)A(M)G(F)C(M)C(F)A(M)G(F)U(M)U(F)U(M)C | SEQ ID NO: 1979 | U(F)C(M)C(F)C(M)A(F)A(M)A(F)C(M)U(F)G(M)G(F)C(M)U(F)C(F)C(M)U(F)G(M)A(F)U(M)A(F)G(M)A | 0.177 | 0.355 |
| AH0649 | SEQ ID NO: 1936 | G(F)A(M)G(F)G(M)A(F)A(M)G(F)C(M)C(F)U(M)G(F)U(M)C | SEQ ID NO: 1980 | U(F)C(M)U(F)C(M)C(F)C(M)A(F)C(M)A(F)G(M)G(F)C(M)U(F)U(F)C(M)C(F)U(M)C(F)A(M)G | 0.084 | 0.196 |
| AH0650 | SEQ ID NO: 1937 | C(F)C(M)A(F)G(M)G(F)C(M)U(F)U(M)C(F)C(M)U(F)U(M)G | SEQ ID NO: 1981 | A(F)U(M)C(F)U(M)C(F)C(M)A(F)G(M)G(F)C(M)U(F)U(M)C(F)C(F)U(M)U(F)G(M)G(F)U(M)A | 0.065 | 0.126 |
| AH0651 | SEQ ID NO: 1938 | C(F)A(M)G(F)G(M)C(F)A(M)G(F)U(M)G(F)A(M)U(F)G(M) | SEQ ID NO: 1982 | A(F)A(M)A(F)A(M)G(F)C(M)A(F)G(M)G(F)C(M)A(F)G(M)U(F)G(F)C(M)U(F)G(M)G(F)C(M) | 0.093 | 0.193 |
| AH0652 | SEQ ID NO: 1939 | U(F)G(M)G(F)G(M)A(F)G(M)A(F)U(M)U(F)U(M) | SEQ ID NO: 1983 | A(F)C(M)A(F)A(F)A(F)U(M)C(F)U(M)C(F)C(M)C(F)U(M)C(F)C(M)A(F)A(M) | 0.170 | 0.380 |
| AH0653 | SEQ ID NO: 1940 | G(F)G(M)G(F)G(M)G(F)A(M)A(F)U(M)U(F)G | SEQ ID NO: 1984 | U(F)C(M)A(F)A(M)C(F)C(M)A(F)U(F)C(F)M)U(F)C(M)A(F)C(M)C(F)C(M) | 0.152 | 0.300 |
| AH0654 | SEQ ID NO: 1941 | G(F)A(M)G(F)A(M)G(F)A(F)A(M)U(F)U(M)G | SEQ ID NO: 1985 | U(F)G(M)U(F)A(M)A(F)A(M)C(F)A(M)A(F)A(M)C(F)U(M)C(F)C(M) | 0.094 | 0.176 |
| AH0655 | SEQ ID NO: 1942 | C(F)C(M)C(F)M(F)A(M)U(F)U(M)C(F)C | SEQ ID NO: 1986 | U(F)A(M)A(F)G(M)C(F)A(M)U(F)U(M)G(F)A(M)G(F)G(M)A(F)C(F)C(M)U(F)G(M)A(F)U(M)G(F)G(M) | 0.123 | 0.332 |
| AH0656 | SEQ ID NO: 1943 | C(F)G(M)G(F)M(F)A(F)U(M)C(F)U(M)G | SEQ ID NO: 1987 | G(F)A(M)U(F)U(M)G(F)M(F)A(F)U(M)C(F)G(M)A(F)M(F)C(F)C(M) | 0.098 | 0.176 |
| AH0657 | SEQ ID NO: 1944 | G(F)A(M)G(F)M(F)A(F)U(M)C(F)U(M)C | SEQ ID NO: 1988 | G(F)U(M)G(F)U(M)G(F)M(F)A(F)G(M)C(F)A(M)A(F)C(M)A(F)C(F)A(M) | 0.147 | 0.338 |
| AH0658 | SEQ ID NO: 1945 | U(F)G(M)G(F)C(M)U(F)C(M)G(F)M(F)A(F)G(M) | SEQ ID NO: 1989 | U(F)G(M)A(F)M(F)A(F)C(M)A(F)M(F)C(F)A(M)C(F)C(F)A(M) | 0.103 | 0.203 |

TABLE 3-continued

| Double stranded nucleic acid No. | SEQ ID NO: | Sense strand sequence (5'--->3') | SEQ ID NO: | Antisense strand sequence (5'--->3') | APCS relative expression level (1 nM) | APCS relative expression level (0.1 nM) |
|---|---|---|---|---|---|---|
| AH0659 | SEQ ID NO: 1946 | A(F)C(M)U(F)C(M)A(F)A(M)C(F)G(M)A(F)G(M)A(F)G(F)C(M)A(F)C(M)A(F)U(F)M(F)A(F)A(M) | SEQ ID NO: 1990 | U(F)U(M)U(F)C(M)A(F)A(M)G(F)U(M)G(F)A(M)G(F)U(M)C(F)A(M)C(F)A(M)G(F)A(M)G(F)U(M)G(F)A(M)G(F)U(M)G(F)A(M) | 0.066 | 0.084 |
| AH0660 | SEQ ID NO: 1947 | C(F)U(M)C(F)A(M)A(F)C(M)G(F)A(M)G(F)A(M)G(F)C(M)A(F)C(M)A(F)U(M)U(F)A(M)A(F)A(M) | SEQ ID NO: 1991 | U(F)U(M)U(F)U(M)A(F)A(M)U(F)G(M)U(F)G(M)C(F)U(M)C(F)U(M)C(F)G(M)U(F)U(M)G(F)A(M)G(F)C(M)U | 0.067 | 0.066 |
| AH0661 | SEQ ID NO: 1948 | U(F)C(M)A(F)A(M)C(F)G(M)A(F)G(M)A(F)G(M)C(F)A(M)C(F)A(M)U(F)U(M)A(F)A(M)A(F)C | SEQ ID NO: 1992 | A(F)U(M)U(F)U(M)U(F)A(M)A(F)U(M)G(F)U(M)G(F)C(M)U(F)C(M)U(F)C(M)G(F)U(M)U(F)G(M)C | 0.058 | 0.074 |
| AH0662 | SEQ ID NO: 1949 | A(F)A(M)C(F)G(M)A(F)G(M)A(F)G(M)C(F)A(M)C(F)A(M)U(F)U(M)A(F)A(M)A(F)C(M)A | SEQ ID NO: 1993 | U(F)C(M)A(F)U(M)U(F)U(M)U(F)A(M)A(F)U(M)G(F)U(M)G(F)C(M)U(F)C(M)U(F)C(M)G(F)U(M)U(F)G(M)U | 0.046 | 0.091 |
| AH0663 | SEQ ID NO: 1950 | A(F)C(M)G(F)A(M)G(F)A(M)G(F)C(M)A(F)C(M)A(F)U(M)U(F)A(M)A(F)A(M)C(F)A(M)U | SEQ ID NO: 1994 | U(F)U(M)C(F)A(M)U(F)U(M)U(F)U(M)U(F)A(M)A(F)U(M)G(F)U(M)G(F)C(M)U(F)C(M)U(F)C(M)G(F) | 0.053 | 0.068 |
| AH0664 | SEQ ID NO: 1951 | C(F)G(M)A(F)G(M)A(F)G(M)C(F)A(M)C(F)A(M)U(F)U(M)A(F)A(M)A(F)C(M)A(F)U(M)U | SEQ ID NO: 1995 | U(F)U(M)U(F)C(M)A(F)U(M)U(F)U(M)U(F)A(M)A(F)U(M)G(F)U(M)G(F)C(M)U(F)C(M)U(F)C(M)G(F)M(F)A | 0.057 | 0.076 |
| AH0665 | SEQ ID NO: 1952 | G(F)A(M)G(F)A(M)G(F)C(M)A(F)C(M)A(F)U(M)U(F)A(M)A(F)A(M)C(F)A(M)U(F)U(M)G | SEQ ID NO: 1996 | A(F)U(M)U(F)U(M)U(F)U(M)C(F)A(M)U(F)U(M)U(F)U(M)A(F)A(M)U(F)G(M)U(F)G(M)C(F)U(M)C | 0.062 | 0.082 |
| AH0666 | SEQ ID NO: 1953 | A(F)G(M)A(F)G(M)C(F)A(M)C(F)A(M)U(F)U(M)A(F)A(M)A(F)C(M)A(F)U(M)U(F)G(M)A | SEQ ID NO: 1997 | A(F)A(M)A(F)U(M)U(F)U(M)U(F)C(M)A(F)U(M)U(F)U(M)U(F)A(M)A(F)U(M)G(F)U(M)G(F)C | 0.062 | 0.083 |
| AH0667 | SEQ ID NO: 1954 | C(F)U(M)G(F)G(M)U(F)C(M)A(F)A(M)A(F)A(M)G(F)C(M)A(F)U(M)U(F)C(M)U(F)G(M)U | SEQ ID NO: 1998 | C(F)A(M)C(F)A(M)G(F)A(M)A(F)U(M)G(F)C(M)U(F)U(M)U(F)U(M)C(F)U(M)C(F)A(M)G | 0.093 | 0.131 |
| AH0668 | SEQ ID NO: 1955 | C(F)U(M)G(F)G(M)U(F)C(M)A(F)A(M)A(F)A(M)G(F)C(M) | SEQ ID NO: 1999 | G(F)U(M)A(F)U(M)C(F)M(F)A(M)A(F)G(M)U(F)U(M)G(M)C | 0.157 | 0.319 |
| AH0669 | SEQ ID NO: 1956 | A(F)A(M)G(F)C(M)A(F)U(M)U(F)C(M)U(F)G(M)U(F)G(M)A | SEQ ID NO: 2000 | A(F)G(M)A(F)U(M)C(F)A(M)C(F)A(M)G(F)A(M)A(F)U(M)G(F)C(M)U | 0.083 | 0.126 |
| AH0670 | SEQ ID NO: 1957 | A(F)A(M)G(F)C(M)A(F)U(M)U(F)C(M)U(F)G(M)U(F)G(M)A(F)U(M)C(F)M(F)A(M)U | SEQ ID NO: 2001 | A(F)U(M)A(F)G(M)A(F)A(M)U(F)G(M)A(F)U(M)C(F)A(M)C(F)A(M)G(F)A(M)A(F)U(M)G(F)C(M)U | 0.071 | 0.129 |
| AH0671 | SEQ ID NO: 1958 | U(F)U(M)C(F)U(M)G(F)U(M)A(F)U(M)C(F)A(M)C(F)A(M)G(F)A(M)A(F)U(M)G(F)C(M)U | SEQ ID NO: 2002 | U(F)A(M)G(F)C(M)A(F)U(M)U(F)C(M)U(F)G(M)U(F)G(M)A(F)U(M)C(F)A(M)C(F)A(M)G(F)C(M)U | 0.115 | 0.181 |
| AH0672 | SEQ ID NO: 1959 | G(F)G(FC(M)A(F)U(M)U(F)A(M)C(F)C(M)A(F)A(M)U(F)C(M)C(F)A(M)M(F)U(M)U | SEQ ID NO: 2003 | C(F)A(M)A(F)A(M)G(F)A(M)G(F)M(F)C(M)A(F)A(M)A(F)A(M)A(F)M(F)G(M)C(F)M(F)M | 0.072 | 0.093 |
| AH0673 | SEQ ID NO: 1960 | U(F)C(M)A(F)C(M)C(F)U(M)U(F)G(M)G(F)M(F)C(M)A(F)A(M)G(F)C(M) | SEQ ID NO: 2004 | G(F)A(M)G(F)M(F)G(F)A(M)G(F)A(M)A(F)A(M)A(F)G(F)M(F)M(F)C(M)U(M)A(F)U(M) | 0.089 | 0.112 |
| AH0674 | SEQ ID NO: 1961 | A(F)C(M)A(F)M(F)C(F)U(M)M(F)M(F)M(F)M(F)M(F)C(M)U(F)M(F)M(F)M(F)C(M)A(F)G(M)C | SEQ ID NO: 2005 | A(F)G(M)A(F)M(F)A(F)G(M)A(F)A(F)G(M)A(F)M(F)A(F)M(F)U(M)G(F)M(F)A(F)U(M)G(F)M(F)A(F)A(M) | 0.067 | 0.082 |

TABLE 3 -continued

| Double stranded nucleic acid No. | SEQ ID NO: | Sense strand sequence (5'--->3') | SEQ ID NO: | Antisense strand sequence (5'--->3') | APCS relative expression level (1 nM) | APCS relative expression level (0.1 nM) |
|---|---|---|---|---|---|---|
| AH0675 | SEQ ID NO: 1962 | C(F)A(M)U(F)C(M)U(F)G(M)C(F)A(M)G(F)C(M)U(F)C(M)U(M)C(F)U(M)U(F)U(M)C(F)U(M)U(F)U(M) | SEQ ID NO: 2006 | A(F)A(M)G(F)A(M)A(F)G(M)A(F)A(M)A(F)G(M)A(F)G(M)A(F)C(M)A(F)A(M)G(F)A(M)G(F)A(M)U(F)A(M) | 0.098 | 0.114 |
| AH0676 | SEQ ID NO: 1963 | A(F)U(M)C(F)U(M)G(F)C(M)A(F)G(M)C(F)U(M)C(F)U(F)U(M)C(F)U(M)U(F)U(M) | SEQ ID NO: 2007 | A(F)A(M)A(F)G(M)A(F)A(M)G(F)A(M)A(F)G(M)A(F)A(M)G(F)A(M)G(F)A(M)C(F)A(M)G(F)A(M)U(F)U(M) | 0.093 | 0.144 |
| AH0677 | SEQ ID NO: 1964 | U(F)C(M)U(F)G(M)C(F)A(M)G(F)C(M)U(F)C(M)U(F)U(M)C(F)U(M)U(F)U(M)G(F)U(M) | SEQ ID NO: 2008 | C(F)A(M)A(F)A(M)A(F)G(M)A(F)A(M)A(F)G(M)A(F)A(M)G(F)A(M)G(F)A(M)C(F)A(M)G(F)A(M) | 0.084 | 0.093 |
| AH0678 | SEQ ID NO: 1965 | C(F)U(M)G(F)C(M)A(F)G(M)C(F)U(M)C(F)U(M)U(F)U(M)C(F)U(M)U(F)U(M)G(F)A(M) | SEQ ID NO: 2009 | U(F)C(M)A(F)A(M)A(F)G(M)A(F)A(M)A(F)G(M)A(F)A(M)G(F)A(M)G(F)A(M)C(F)A(M)G(F)A(M)U(F)U(M) | 0.089 | 0.100 |
| AH0679 | SEQ ID NO: 1966 | U(F)G(M)C(F)A(M)G(F)C(M)U(F)C(M)U(F)U(M)C(F)U(M)U(F)U(M)G(F)A(M)A(F)A(M) | SEQ ID NO: 2010 | U(F)U(M)C(F)A(M)A(F)A(M)G(F)A(M)A(F)A(M)G(F)A(M)A(F)G(M)A(F)G(M)A(F)C(F)A(M)G(F)A(M) | 0.101 | 0.158 |
| AH0680 | SEQ ID NO: 1967 | G(F)C(M)A(F)G(M)C(F)U(M)C(F)U(M)U(F)U(M)U(F)U(M) | SEQ ID NO: 2011 | A(F)U(M)U(F)C(M)A(F)A(M)A(F)G(M)A(F)A(M)A(F)G(M)A(F)G(M)A(F)C(F)G(M) | 0.086 | 0.112 |
| AH0681 | SEQ ID NO: 1968 | C(F)A(M)G(F)C(M)U(F)C(M)U(F)U(M)U(F)U(M) | SEQ ID NO: 2012 | A(F)A(M)U(F)U(M)C(F)A(M)A(F)A(M)G(F)A(M)A(F)A(M)G(F)A(M)A(F)G(M)A(F)G(M)A(F)C(F)A(M) | 0.088 | 0.119 |
| AH0682 | SEQ ID NO: 1969 | U(F)A(M)G(F)C(M)U(F)C(M)U(F)U(M)U(F)U(M) | SEQ ID NO: 2013 | A(F)C(M)A(F)A(M)U(F)U(M)C(F)A(M)A(F)A(M)G(F)A(M)A(F)A(M)G(F)A(M)A(F)G(M) | 0.052 | 0.064 |
| AH0683 | SEQ ID NO: 1970 | U(F)C(M)C(F)U(M)A(F)U(M)C(F)U(M)G(F)A(M) | SEQ ID NO: 2014 | U(F)A(M)G(F)C(M)A(F)U(M)U(F)C(M)A(F)A(M)A(F)G(M)A(F)A(M)A(F)U(M)A(F)A(M) | 0.062 | 0.089 |
| AH0684 | SEQ ID NO: 1971 | A(F)G(M)C(F)U(M)A(F)U(M)C(F)U(M)A(F)U(M)A(F)A(M) | SEQ ID NO: 2015 | U(F)C(M)A(F)G(M)C(F)C(M)U(F)A(M)A(F)U(M)A(F)C(M)A(F)U(M)A(F)G(M) | 0.055 | 0.083 |
| AH0685 | SEQ ID NO: 1972 | U(F)C(M)U(F)G(M)U(F)A(M)U(F)G(M)U(F)C(M)U(F) | SEQ ID NO: 2016 | U(F)U(M)A(F)A(M)U(F)U(M)A(F)U(M)G(F)G(M)C(F)A(M)G(F)A(M)G(F)A(M)( | 0.073 | 0.099 |
| AH0686 | SEQ ID NO: 1973 | C(F)U(M)G(F)U(M)A(F)U(M)A(F)U(M)G(F) | SEQ ID NO: 2017 | U(F)U(M)A(F)A(M)U(F)U(M)A(F)U(M)A(F)U(M)G(F)G(M)A(F)U(M) | 0.148 | 0.305 |
| AH0687 | SEQ ID NO: 1974 | G(F)U(M)C(F)U(M)A(F)A(M)A(F)A(M)A(F)A(M)U(F)A(M) | SEQ ID NO: 2018 | U(F)A(M)U(F)A(M)A(F)U(M)U(F)A(M)U(F)G(M)C(F)A(M)A(F)U(M) | 0.078 | 0.158 |

This application was filed based on Japanese Patent Application No. 2017-108502 (filing date: May 31, 2017), the entire contents of which are incorporated herein by reference.

Owing to the present invention, it is possible to provide a nucleic acid having an activity to suppress expression of APCS and a pharmaceutical composition comprising the nucleic acid as an active ingredient. The nucleic acid and pharmaceutical composition of the present invention can suppress expression of APCS and be used as a therapeutic or prophylactic agent for amyloid-related diseases.

Sequence Listing Free Text

SEQ ID NO: 1 represents the full-length base sequence of the 2nd strand cDNA of APCS.
SEQ ID NOs: 2 to 644 represent the base sequences of sense-strand nucleic acids.
SEQ ID NOs: 645 to 1287 represent the base sequences of antisense-strand nucleic acids.
SEQ ID NOs: 1288 to 1930 represent the base sequences of target APCS mRNA sequences.
SEQ ID NOs: 1931 to 1974 represent the base sequences of sense-strand nucleic acids.
SEQ ID NOs: 1975 to 2018 represent the base sequences of the antisense-strand nucleic acids.

SEQUENCE LISTING (2018 sequences)

SEQ ID NO: 1 - DNA, 960 bp, Homo sapiens
gggcatgaatatcagacgctagggggacagccactgtgttgtctgctaccctcatcctggtcactgcttctgctataacagccctaggccaggaatatgaacaagccgctgctttggatctctgtcctcaccagcctcctggaagcctttgctcacacagacctcagtgggaaggtgtttgtatttcctagagaatctgttactgatcatgtaaacttgatcacaccgctggagaagcctctacagaactttaccttgtgttttcgagcctatagtgatctctctcgtgcctacagcctcttctcctacaatacccaaggcagggataatgagctactagtttataaagaaagagttggagagtatagtctatacattggaagacacaaagttacatccaaagttatcgaaaagttcccggctccagtgcacatctgtgtgagctgggagtcctcatcaggtattgctgaattttggatcaatgggacacctttggtgaaaaagggtctgcgacagggttactttgtagaagctcagcccaagattgtcctggggcaggaacaggattcctatgggggcaagtttgataggagccagtcctttgtgggagagattggggatttgtacatgtgggactctgtgctgcccccagaaaatatcctgtctgcctatcagggtacccctctccctgccaatatcctggactggcaggctctgaactatgaaatcagaggatatgtcatcatcaaacccttggtgtgggtctgaggtcttgactcaacgagagcacttgaaaatgaaatgactgtctaagagatctggtcaaagcaactggatactagatcttacatctgcagctctttcttctttgaatttcctatctgtatgtctgcctaattaaaaaaatatatattgtattatgctacctgcaaaaaaaaaaaaaaaaaaaaaaaaaaaaaa

SEQ ID NO: 2 - RNA, 21 nt, Artificial Sequence
  siRNA sense strand against APCS
gcaugaauaucagacgcuagg

SEQ ID NO: 3 - RNA, 21 nt, Artificial Sequence
  siRNA sense strand against APCS
caugaauaucagacgcuaggg

SEQ ID NO: 4 - RNA, 21 nt, Artificial Sequence
  siRNA sense strand against APCS
auaucagacgcuagggggaca

SEQ ID NO: 5 - RNA, 21 nt, Artificial Sequence
  siRNA sense strand against APCS
cuagggggacagccacugugu

SEQ ID NO: 6 - RNA, 21 nt, Artificial Sequence
  siRNA sense strand against APCS
agggggacagccacuguguug

SEQ ID NO: 7 - RNA, 21 nt, Artificial Sequence
  siRNA sense strand against APCS
ggggacagccacuguguuguc

SEQ ID NO: 8 - RNA, 21 nt, Artificial Sequence
  siRNA sense strand against APCS
gggacagccacuguguugucu

SEQ ID NO: 9 - RNA, 21 nt, Artificial Sequence
  siRNA sense strand against APCS
ggacagccacuguguugucug

SEQ ID NO: 10 - RNA, 21 nt, Artificial Sequence
  siRNA sense strand against APCS
gacagccacuguguugucugc

SEQ ID NO: 11 - RNA, 21 nt, Artificial Sequence
  siRNA sense strand against APCS
gccacuguguugucugcuacc

SEQ ID NO: 12 - RNA, 21 nt, Artificial Sequence
  siRNA sense strand against APCS
ccacuguguugucugcuaccc

SEQ ID NO: 13 - RNA, 21 nt, Artificial Sequence
  siRNA sense strand against APCS
cacuguguugucugcuacccu

SEQ ID NO: 14 - RNA, 21 nt, Artificial Sequence
  siRNA sense strand against APCS
cuguguugucugcuacccuca

SEQ ID NO: 15 - RNA, 21 nt, Artificial Sequence
  siRNA sense strand against APCS
uguguugucugcuacccucau

SEQ ID NO: 16 - RNA, 21 nt, Artificial Sequence
  siRNA sense strand against APCS
guguugucugcuacccucauc

SEQ ID NO: 17 - RNA, 21 nt, Artificial Sequence
  siRNA sense strand against APCS
uguugucugcuacccucaucc

SEQ ID NO: 18 - RNA, 21 nt, Artificial Sequence
  siRNA sense strand against APCS
guugucugcuacccucauccu

SEQ ID NO: 19 - RNA, 21 nt, Artificial Sequence
  siRNA sense strand against APCS
gucugcuacccucauccuggu

SEQ ID NO: 20 - RNA, 21 nt, Artificial Sequence
  siRNA sense strand against APCS
cugcuacccucauccugguca

SEQ ID NO: 21 - RNA, 21 nt, Artificial Sequence
  siRNA sense strand against APCS
gcuacccucauccuggucacu

SEQ ID NO: 22 - RNA, 21 nt, Artificial Sequence
  siRNA sense strand against APCS
cuacccucauccuggucacug

SEQ ID NO: 23 - RNA, 21 nt, Artificial Sequence
  siRNA sense strand against APCS
uacccucauccuggucacugc

SEQ ID NO: 24 - RNA, 21 nt, Artificial Sequence
  siRNA sense strand against APCS
acccucauccuggucacugcu

SEQ ID NO: 25 - RNA, 21 nt, Artificial Sequence
  siRNA sense strand against APCS
cccucauccuggucacugcuu

SEQ ID NO: 26 - RNA, 21 nt, Artificial Sequence
  siRNA sense strand against APCS
ccucauccuggucacugcuuc

SEQ ID NO: 27 - RNA, 21 nt, Artificial Sequence
  siRNA sense strand against APCS
cucauccuggucacugcuucu

SEQ ID NO: 28 - RNA, 21 nt, Artificial Sequence
  siRNA sense strand against APCS
cauccuggucacugcuucugc

SEQ ID NO: 29 - RNA, 21 nt, Artificial Sequence
  siRNA sense strand against APCS
auccuggucacugcuucugcu

SEQ ID NO: 30 - RNA, 21 nt, Artificial Sequence
  siRNA sense strand against APCS
uccuggucacugcuucugcua

SEQ ID NO: 31 - RNA, 21 nt, Artificial Sequence
  siRNA sense strand against APCS
ccuggucacugcuucugcuau

SEQ ID NO: 32 - RNA, 21 nt, Artificial Sequence
  siRNA sense strand against APCS
cuggucacugcuucugcuaua

SEQ ID NO: 33 - RNA, 21 nt, Artificial Sequence
  siRNA sense strand against APCS
uggucacugcuucugcuauaa

SEQ ID NO: 34 - RNA, 21 nt, Artificial Sequence
  siRNA sense strand against APCS
ggucacugcuucugcuauaac

SEQ ID NO: 35 - RNA, 21 nt, Artificial Sequence
  siRNA sense strand against APCS
gucacugcuucugcuauaaca

SEQ ID NO: 36 - RNA, 21 nt, Artificial Sequence
  siRNA sense strand against APCS
cacugcuucugcuauaacagc

SEQ ID NO: 37 - RNA, 21 nt, Artificial Sequence
  siRNA sense strand against APCS
acugcuucugcuauaacagcc

SEQ ID NO: 38 - RNA, 21 nt, Artificial Sequence
  siRNA sense strand against APCS
cugcuucugcuauaacagccc

SEQ ID NO: 39 - RNA, 21 nt, Artificial Sequence
  siRNA sense strand against APCS
gcuucugcuauaacagcccua

SEQ ID NO: 40 - RNA, 21 nt, Artificial Sequence
  siRNA sense strand against APCS
cuucugcuauaacagcccuag

SEQ ID NO: 41 - RNA, 21 nt, Artificial Sequence
  siRNA sense strand against APCS
uucugcuauaacagcccuagg

SEQ ID NO: 42 - RNA, 21 nt, Artificial Sequence
  siRNA sense strand against APCS
ucugcuauaacagcccuaggc

SEQ ID NO: 43 - RNA, 21 nt, Artificial Sequence
  siRNA sense strand against APCS
cugcuauaacagcccuaggcc

SEQ ID NO: 44 - RNA, 21 nt, Artificial Sequence
  siRNA sense strand against APCS
ugcuauaacagcccuaggcca

SEQ ID NO: 45 - RNA, 21 nt, Artificial Sequence
  siRNA sense strand against APCS
gcuauaacagcccuaggccag

SEQ ID NO: 46 - RNA, 21 nt, Artificial Sequence
  siRNA sense strand against APCS
cuauaacagcccuaggccagg

SEQ ID NO: 47 - RNA, 21 nt, Artificial Sequence
  siRNA sense strand against APCS
uauaacagcccuaggccagga

SEQ ID NO: 48 - RNA, 21 nt, Artificial Sequence
  siRNA sense strand against APCS
auaacagcccuaggccaggaa

SEQ ID NO: 49 - RNA, 21 nt, Artificial Sequence
  siRNA sense strand against APCS
uaacagcccuaggccaggaau

SEQ ID NO: 50 - RNA, 21 nt, Artificial Sequence
  siRNA sense strand against APCS
acagcccuaggccaggaauau

SEQ ID NO: 51 - RNA, 21 nt, Artificial Sequence
  siRNA sense strand against APCS
cagcccuaggccaggaauaug

SEQ ID NO: 52 - RNA, 21 nt, Artificial Sequence
  siRNA sense strand against APCS
agcccuaggccaggaauauga

SEQ ID NO: 53 - RNA, 21 nt, Artificial Sequence
  siRNA sense strand against APCS
gcccuaggccaggaauaugaa

SEQ ID NO: 54 - RNA, 21 nt, Artificial Sequence
  siRNA sense strand against APCS
cccuaggccaggaauaugaac

SEQ ID NO: 55 - RNA, 21 nt, Artificial Sequence
  siRNA sense strand against APCS
ccuaggccaggaauaugaaca

SEQ ID NO: 56 - RNA, 21 nt, Artificial Sequence
  siRNA sense strand against APCS
cuaggccaggaauaugaacaa

SEQ ID NO: 57 - RNA, 21 nt, Artificial Sequence
  siRNA sense strand against APCS
uaggccaggaauaugaacaag

SEQ ID NO: 58 - RNA, 21 nt, Artificial Sequence
  siRNA sense strand against APCS
aggccaggaauaugaacaagc

SEQ ID NO: 59 - RNA, 21 nt, Artificial Sequence
  siRNA sense strand against APCS
ggccaggaauaugaacaagcc

SEQ ID NO: 60 - RNA, 21 nt, Artificial Sequence
  siRNA sense strand against APCS
gccaggaauaugaacaagccg

SEQ ID NO: 61 - RNA, 21 nt, Artificial Sequence
  siRNA sense strand against APCS
ccaggaauaugaacaagccgc

SEQ ID NO: 62 - RNA, 21 nt, Artificial Sequence
  siRNA sense strand against APCS
caggaauaugaacaagccgcu

SEQ ID NO: 63 - RNA, 21 nt, Artificial Sequence
  siRNA sense strand against APCS
aggaauaugaacaagccgcug

SEQ ID NO: 64 - RNA, 21 nt, Artificial Sequence
  siRNA sense strand against APCS
ggaauaugaacaagccgcugc

SEQ ID NO: 65 - RNA, 21 nt, Artificial Sequence
  siRNA sense strand against APCS
gaauaugaacaagccgcugcu

SEQ ID NO: 66 - RNA, 21 nt, Artificial Sequence
  siRNA sense strand against APCS
aauaugaacaagccgcugcuu

SEQ ID NO: 67 - RNA, 21 nt, Artificial Sequence
  siRNA sense strand against APCS
auaugaacaagccgcugcuuu

SEQ ID NO: 68 - RNA, 21 nt, Artificial Sequence
  siRNA sense strand against APCS
uaugaacaagccgcugcuuug

SEQ ID NO: 69 - RNA, 21 nt, Artificial Sequence
  siRNA sense strand against APCS
augaacaagccgcugcuuugg

SEQ ID NO: 70 - RNA, 21 nt, Artificial Sequence
  siRNA sense strand against APCS
ugaacaagccgcugcuuugga

SEQ ID NO: 71 - RNA, 21 nt, Artificial Sequence
  siRNA sense strand against APCS
gaacaagccgcugcuuuggau

SEQ ID NO: 72 - RNA, 21 nt, Artificial Sequence
  siRNA sense strand against APCS
aacaagccgcugcuuuggauc

SEQ ID NO: 73 - RNA, 21 nt, Artificial Sequence
  siRNA sense strand against APCS
acaagccgcugcuuuggaucu

SEQ ID NO: 74 - RNA, 21 nt, Artificial Sequence
  siRNA sense strand against APCS
caagccgcugcuuuggaucuc

SEQ ID NO: 75 - RNA, 21 nt, Artificial Sequence
  siRNA sense strand against APCS
aagccgcugcuuuggaucucu

SEQ ID NO: 76 - RNA, 21 nt, Artificial Sequence
  siRNA sense strand against APCS
agccgcugcuuuggaucucug

SEQ ID NO: 77 - RNA, 21 nt, Artificial Sequence
  siRNA sense strand against APCS
gccgcugcuuuggaucucugu

SEQ ID NO: 78 - RNA, 21 nt, Artificial Sequence
  siRNA sense strand against APCS
ccgcugcuuuggaucucuguc

SEQ ID NO: 79 - RNA, 21 nt, Artificial Sequence
  siRNA sense strand against APCS
cgcugcuuuggaucucugucc

SEQ ID NO: 80 - RNA, 21 nt, Artificial Sequence
  siRNA sense strand against APCS
gcugcuuuggaucucuguccu

SEQ ID NO: 81 - RNA, 21 nt, Artificial Sequence
  siRNA sense strand against APCS
cugcuuuggaucucuguccuc

SEQ ID NO: 82 - RNA, 21 nt, Artificial Sequence
  siRNA sense strand against APCS
ugcuuuggaucucuguccuca

SEQ ID NO: 83 - RNA, 21 nt, Artificial Sequence
  siRNA sense strand against APCS
gcuuuggaucucuguccucac

SEQ ID NO: 84 - RNA, 21 nt, Artificial Sequence
  siRNA sense strand against APCS
cuuuggaucucuguccucacc

SEQ ID NO: 85 - RNA, 21 nt, Artificial Sequence
  siRNA sense strand against APCS
uuuggaucucuguccucacca

SEQ ID NO: 86 - RNA, 21 nt, Artificial Sequence
  siRNA sense strand against APCS
ggaucucuguccucaccagcc

SEQ ID NO: 87 - RNA, 21 nt, Artificial Sequence
  siRNA sense strand against APCS
gaucucuguccucaccagccu

SEQ ID NO: 88 - RNA, 21 nt, Artificial Sequence
  siRNA sense strand against APCS
cucuguccucaccagccuccu

SEQ ID NO: 89 - RNA, 21 nt, Artificial Sequence
  siRNA sense strand against APCS
cuguccucaccagccuccugg

SEQ ID NO: 90 - RNA, 21 nt, Artificial Sequence
  siRNA sense strand against APCS
uguccucaccagccuccugga

SEQ ID NO: 91 - RNA, 21 nt, Artificial Sequence
  siRNA sense strand against APCS
guccucaccagccuccuggaa

SEQ ID NO: 92 - RNA, 21 nt, Artificial Sequence
  siRNA sense strand against APCS
uccucaccagccuccuggaag

SEQ ID NO: 93 - RNA, 21 nt, Artificial Sequence
  siRNA sense strand against APCS
cucaccagccuccuggaagcc

SEQ ID NO: 94 - RNA, 21 nt, Artificial Sequence
  siRNA sense strand against APCS
ucaccagccuccuggaagccu

SEQ ID NO: 95 - RNA, 21 nt, Artificial Sequence
  siRNA sense strand against APCS
accagccuccuggaagccuuu

SEQ ID NO: 96 - RNA, 21 nt, Artificial Sequence
  siRNA sense strand against APCS
ccagccuccuggaagccuuug

SEQ ID NO: 97 - RNA, 21 nt, Artificial Sequence
  siRNA sense strand against APCS
cagccuccuggaagccuuugc

SEQ ID NO: 98 - RNA, 21 nt, Artificial Sequence
  siRNA sense strand against APCS
agccuccuggaagccuuugcu

SEQ ID NO: 99 - RNA, 21 nt, Artificial Sequence
  siRNA sense strand against APCS
gccuccuggaagccuuugcuc

SEQ ID NO: 100 - RNA, 21 nt, Artificial Sequence
  siRNA sense strand against APCS
ccuccuggaagccuuugcuca

SEQ ID NO: 101 - RNA, 21 nt, Artificial Sequence
  siRNA sense strand against APCS
cuccuggaagccuuugcucac

SEQ ID NO: 102 - RNA, 21 nt, Artificial Sequence
  siRNA sense strand against APCS
uccuggaagccuuugcucaca

SEQ ID NO: 103 - RNA, 21 nt, Artificial Sequence
  siRNA sense strand against APCS
ccuggaagccuuugcucacac

SEQ ID NO: 104 - RNA, 21 nt, Artificial Sequence
  siRNA sense strand against APCS
cuggaagccuuugcucacaca

SEQ ID NO: 105 - RNA, 21 nt, Artificial Sequence
  siRNA sense strand against APCS
ggaagccuuugcucacacaga

SEQ ID NO: 106 - RNA, 21 nt, Artificial Sequence
  siRNA sense strand against APCS
gaagccuuugcucacacagac

SEQ ID NO: 107 - RNA, 21 nt, Artificial Sequence
  siRNA sense strand against APCS
aagccuuugcucacacagacc

SEQ ID NO: 108 - RNA, 21 nt, Artificial Sequence
  siRNA sense strand against APCS
agccuuugcucacacagaccu

SEQ ID NO: 109 - RNA, 21 nt, Artificial Sequence
  siRNA sense strand against APCS
gccuuugcucacacagaccuc

SEQ ID NO: 110 - RNA, 21 nt, Artificial Sequence
  siRNA sense strand against APCS
ccuuugcucacacagaccuca

SEQ ID NO: 111 - RNA, 21 nt, Artificial Sequence
  siRNA sense strand against APCS
cuuugcucacacagaccucag

SEQ ID NO: 112 - RNA, 21 nt, Artificial Sequence
  siRNA sense strand against APCS
uuugcucacacagaccucagu

SEQ ID NO: 113 - RNA, 21 nt, Artificial Sequence
  siRNA sense strand against APCS
ugcucacacagaccucagugg

SEQ ID NO: 114 - RNA, 21 nt, Artificial Sequence
  siRNA sense strand against APCS
cucacacagaccucaguggga

SEQ ID NO: 115 - RNA, 21 nt, Artificial Sequence
  siRNA sense strand against APCS
cacacagaccucagugggaag

SEQ ID NO: 116 - RNA, 21 nt, Artificial Sequence
  siRNA sense strand against APCS
acacagaccucagugggaagg

SEQ ID NO: 117 - RNA, 21 nt, Artificial Sequence
  siRNA sense strand against APCS
cacagaccucagugggaaggu

SEQ ID NO: 118 - RNA, 21 nt, Artificial Sequence
  siRNA sense strand against APCS
agaccucagugggaagguguu

SEQ ID NO: 119 - RNA, 21 nt, Artificial Sequence
  siRNA sense strand against APCS
gaccucagugggaagguguuu

SEQ ID NO: 120 - RNA, 21 nt, Artificial Sequence
  siRNA sense strand against APCS
accucagugggaagguguuug

SEQ ID NO: 121 - RNA, 21 nt, Artificial Sequence
  siRNA sense strand against APCS
ccucagugggaagguguuugu

SEQ ID NO: 122 - RNA, 21 nt, Artificial Sequence
  siRNA sense strand against APCS
cucagugggaagguguuugua

SEQ ID NO: 123 - RNA, 21 nt, Artificial Sequence
  siRNA sense strand against APCS
ucagugggaagguguuuguau

SEQ ID NO: 124 - RNA, 21 nt, Artificial Sequence
  siRNA sense strand against APCS
cagugggaagguguuuguauu

SEQ ID NO: 125 - RNA, 21 nt, Artificial Sequence
  siRNA sense strand against APCS
agugggaagguguuuguauuu

SEQ ID NO: 126 - RNA, 21 nt, Artificial Sequence
  siRNA sense strand against APCS
gugggaagguguuuguauuuc

SEQ ID NO: 127 - RNA, 21 nt, Artificial Sequence
  siRNA sense strand against APCS
ugggaagguguuuguauuucc

SEQ ID NO: 128 - RNA, 21 nt, Artificial Sequence
  siRNA sense strand against APCS
gggaagguguuuguauuuccu

SEQ ID NO: 129 - RNA, 21 nt, Artificial Sequence
  siRNA sense strand against APCS
ggaagguguuuguauuuccua

SEQ ID NO: 130 - RNA, 21 nt, Artificial Sequence
  siRNA sense strand against APCS
gaagguguuuguauuuccuag

SEQ ID NO: 131 - RNA, 21 nt, Artificial Sequence
  siRNA sense strand against APCS
aagguguuuguauuuccuaga

SEQ ID NO: 132 - RNA, 21 nt, Artificial Sequence
  siRNA sense strand against APCS
agguguuuguauuuccuagag

SEQ ID NO: 133 - RNA, 21 nt, Artificial Sequence
  siRNA sense strand against APCS
gguguuuguauuuccuagaga

SEQ ID NO: 134 - RNA, 21 nt, Artificial Sequence
  siRNA sense strand against APCS
guguuuguauuuccuagagaa

SEQ ID NO: 135 - RNA, 21 nt, Artificial Sequence
  siRNA sense strand against APCS
uguuuguauuuccuagagaau

SEQ ID NO: 136 - RNA, 21 nt, Artificial Sequence
  siRNA sense strand against APCS
guuuguauuuccuagagaauc

SEQ ID NO: 137 - RNA, 21 nt, Artificial Sequence
  siRNA sense strand against APCS
uuuguauuuccuagagaaucu

SEQ ID NO: 138 - RNA, 21 nt, Artificial Sequence
  siRNA sense strand against APCS
uuguauuuccuagagaaucug

SEQ ID NO: 139 - RNA, 21 nt, Artificial Sequence
  siRNA sense strand against APCS
uguauuuccuagagaaucugu

SEQ ID NO: 140 - RNA, 21 nt, Artificial Sequence
  siRNA sense strand against APCS
guauuuccuagagaaucuguu

SEQ ID NO: 141 - RNA, 21 nt, Artificial Sequence
  siRNA sense strand against APCS
uauuuccuagagaaucuguua

SEQ ID NO: 142 - RNA, 21 nt, Artificial Sequence
  siRNA sense strand against APCS
auuuccuagagaaucuguuac

SEQ ID NO: 143 - RNA, 21 nt, Artificial Sequence
  siRNA sense strand against APCS
uuuccuagagaaucuguuacu

SEQ ID NO: 144 - RNA, 21 nt, Artificial Sequence
  siRNA sense strand against APCS
uccuagagaaucuguuacuga

SEQ ID NO: 145 - RNA, 21 nt, Artificial Sequence
  siRNA sense strand against APCS
ccuagagaaucuguuacugau

SEQ ID NO: 146 - RNA, 21 nt, Artificial Sequence
  siRNA sense strand against APCS
cuagagaaucuguuacugauc

SEQ ID NO: 147 - RNA, 21 nt, Artificial Sequence
  siRNA sense strand against APCS
uagagaaucuguuacugauca

SEQ ID NO: 148 - RNA, 21 nt, Artificial Sequence
  siRNA sense strand against APCS
agagaaucuguuacugaucau

SEQ ID NO: 149 - RNA, 21 nt, Artificial Sequence
  siRNA sense strand against APCS
gagaaucuguuacugaucaug

SEQ ID NO: 150 - RNA, 21 nt, Artificial Sequence
  siRNA sense strand against APCS
agaaucuguuacugaucaugu

SEQ ID NO: 151 - RNA, 21 nt, Artificial Sequence
  siRNA sense strand against APCS
gaaucuguuacugaucaugua

SEQ ID NO: 152 - RNA, 21 nt, Artificial Sequence
  siRNA sense strand against APCS
aaucuguuacugaucauguaa

SEQ ID NO: 153 - RNA, 21 nt, Artificial Sequence
  siRNA sense strand against APCS
aucuguuacugaucauguaaa

SEQ ID NO: 154 - RNA, 21 nt, Artificial Sequence
  siRNA sense strand against APCS
ucuguuacugaucauguaaac

SEQ ID NO: 155 - RNA, 21 nt, Artificial Sequence
  siRNA sense strand against APCS
cuguuacugaucauguaaacu

SEQ ID NO: 156 - RNA, 21 nt, Artificial Sequence
  siRNA sense strand against APCS
uguuacugaucauguaaacuu

SEQ ID NO: 157 - RNA, 21 nt, Artificial Sequence
  siRNA sense strand against APCS
guuacugaucauguaaacuug

SEQ ID NO: 158 - RNA, 21 nt, Artificial Sequence
  siRNA sense strand against APCS
acugaucauguaaacuugauc

SEQ ID NO: 159 - RNA, 21 nt, Artificial Sequence
  siRNA sense strand against APCS
cugaucauguaaacuugauca

SEQ ID NO: 160 - RNA, 21 nt, Artificial Sequence
  siRNA sense strand against APCS
ugaucauguaaacuugaucac

SEQ ID NO: 161 - RNA, 21 nt, Artificial Sequence
  siRNA sense strand against APCS
gaucauguaaacuugaucaca

SEQ ID NO: 162 - RNA, 21 nt, Artificial Sequence
  siRNA sense strand against APCS
ucauguaaacuugaucacacc

SEQ ID NO: 163 - RNA, 21 nt, Artificial Sequence
  siRNA sense strand against APCS
cauguaaacuugaucacaccg

SEQ ID NO: 164 - RNA, 21 nt, Artificial Sequence
  siRNA sense strand against APCS
uaaacuugaucacaccgcugg

SEQ ID NO: 165 - RNA, 21 nt, Artificial Sequence
  siRNA sense strand against APCS
aaacuugaucacaccgcugga

SEQ ID NO: 166 - RNA, 21 nt, Artificial Sequence
  siRNA sense strand against APCS
acuugaucacaccgcuggaga

SEQ ID NO: 167 - RNA, 21 nt, Artificial Sequence
  siRNA sense strand against APCS
uugaucacaccgcuggagaag

SEQ ID NO: 168 - RNA, 21 nt, Artificial Sequence
  siRNA sense strand against APCS
ugaucacaccgcuggagaagc

SEQ ID NO: 169 - RNA, 21 nt, Artificial Sequence
  siRNA sense strand against APCS
gaucacaccgcuggagaagcc

SEQ ID NO: 170 - RNA, 21 nt, Artificial Sequence
  siRNA sense strand against APCS
cacaccgcuggagaagccucu

SEQ ID NO: 171 - RNA, 21 nt, Artificial Sequence
  siRNA sense strand against APCS
acaccgcuggagaagccucua

SEQ ID NO: 172 - RNA, 21 nt, Artificial Sequence
  siRNA sense strand against APCS
caccgcuggagaagccucuac

SEQ ID NO: 173 - RNA, 21 nt, Artificial Sequence
  siRNA sense strand against APCS
accgcuggagaagccucuaca

SEQ ID NO: 174 - RNA, 21 nt, Artificial Sequence
  siRNA sense strand against APCS
ccgcuggagaagccucuacag

SEQ ID NO: 175 - RNA, 21 nt, Artificial Sequence
  siRNA sense strand against APCS
cgcuggagaagccucuacaga

SEQ ID NO: 176 - RNA, 21 nt, Artificial Sequence
  siRNA sense strand against APCS
gcuggagaagccucuacagaa

SEQ ID NO: 177 - RNA, 21 nt, Artificial Sequence
  siRNA sense strand against APCS
cuggagaagccucuacagaac

SEQ ID NO: 178 - RNA, 21 nt, Artificial Sequence
  siRNA sense strand against APCS
uggagaagccucuacagaacu

SEQ ID NO: 179 - RNA, 21 nt, Artificial Sequence
  siRNA sense strand against APCS
ggagaagccucuacagaacuu

SEQ ID NO: 180 - RNA, 21 nt, Artificial Sequence
  siRNA sense strand against APCS
gagaagccucuacagaacuuu

SEQ ID NO: 181 - RNA, 21 nt, Artificial Sequence
  siRNA sense strand against APCS
agaagccucuacagaacuuua

SEQ ID NO: 182 - RNA, 21 nt, Artificial Sequence
  siRNA sense strand against APCS
gaagccucuacagaacuuuac

SEQ ID NO: 183 - RNA, 21 nt, Artificial Sequence
  siRNA sense strand against APCS
aagccucuacagaacuuuacc

SEQ ID NO: 184 - RNA, 21 nt, Artificial Sequence
  siRNA sense strand against APCS
agccucuacagaacuuuaccu

SEQ ID NO: 185 - RNA, 21 nt, Artificial Sequence
  siRNA sense strand against APCS
gccucuacagaacuuuaccuu

SEQ ID NO: 186 - RNA, 21 nt, Artificial Sequence
  siRNA sense strand against APCS
ccucuacagaacuuuaccuug

SEQ ID NO: 187 - RNA, 21 nt, Artificial Sequence
  siRNA sense strand against APCS
cucuacagaacuuuaccuugu

SEQ ID NO: 188 - RNA, 21 nt, Artificial Sequence
  siRNA sense strand against APCS
ucuacagaacuuuaccuugug

SEQ ID NO: 189 - RNA, 21 nt, Artificial Sequence
  siRNA sense strand against APCS
cuacagaacuuuaccuugugu

SEQ ID NO: 190 - RNA, 21 nt, Artificial Sequence
  siRNA sense strand against APCS
uacagaacuuuaccuuguguu

SEQ ID NO: 191 - RNA, 21 nt, Artificial Sequence
  siRNA sense strand against APCS
acagaacuuuaccuuguguuu

SEQ ID NO: 192 - RNA, 21 nt, Artificial Sequence
  siRNA sense strand against APCS
cagaacuuuaccuuguguuuu

SEQ ID NO: 193 - RNA, 21 nt, Artificial Sequence
  siRNA sense strand against APCS
agaacuuuaccuuguguuuuc

SEQ ID NO: 194 - RNA, 21 nt, Artificial Sequence
  siRNA sense strand against APCS
gaacuuuaccuuguguuuucg

SEQ ID NO: 195 - RNA, 21 nt, Artificial Sequence
  siRNA sense strand against APCS
aacuuuaccuuguguuuucga

SEQ ID NO: 196 - RNA, 21 nt, Artificial Sequence
  siRNA sense strand against APCS
cuuuaccuuguguuuucgagc

SEQ ID NO: 197 - RNA, 21 nt, Artificial Sequence
  siRNA sense strand against APCS
accuuguguuuucgagccuau

SEQ ID NO: 198 - RNA, 21 nt, Artificial Sequence
  siRNA sense strand against APCS
ccuuguguuuucgagccuaua

SEQ ID NO: 199 - RNA, 21 nt, Artificial Sequence
  siRNA sense strand against APCS
cuuguguuuucgagccuauag

SEQ ID NO: 200 - RNA, 21 nt, Artificial Sequence
  siRNA sense strand against APCS
uuguguuuucgagccuauagu

SEQ ID NO: 201 - RNA, 21 nt, Artificial Sequence
  siRNA sense strand against APCS
guguuuucgagccuauaguga

SEQ ID NO: 202 - RNA, 21 nt, Artificial Sequence
  siRNA sense strand against APCS
guuuucgagccuauagugauc

SEQ ID NO: 203 - RNA, 21 nt, Artificial Sequence
  siRNA sense strand against APCS
uuuucgagccuauagugaucu

SEQ ID NO: 204 - RNA, 21 nt, Artificial Sequence
  siRNA sense strand against APCS
cgagccuauagugaucucucu

SEQ ID NO: 205 - RNA, 21 nt, Artificial Sequence
  siRNA sense strand against APCS
gagccuauagugaucucucuc

SEQ ID NO: 206 - RNA, 21 nt, Artificial Sequence
  siRNA sense strand against APCS
agccuauagugaucucucucg

SEQ ID NO: 207 - RNA, 21 nt, Artificial Sequence
  siRNA sense strand against APCS
gccuauagugaucucucucgu

SEQ ID NO: 208 - RNA, 21 nt, Artificial Sequence
  siRNA sense strand against APCS
ccuauagugaucucucucgug

SEQ ID NO: 209 - RNA, 21 nt, Artificial Sequence
  siRNA sense strand against APCS
cuauagugaucucucucgugc

SEQ ID NO: 210 - RNA, 21 nt, Artificial Sequence
  siRNA sense strand against APCS
uauagugaucucucucgugcc

SEQ ID NO: 211 - RNA, 21 nt, Artificial Sequence
  siRNA sense strand against APCS
agugaucucucucgugccuac

SEQ ID NO: 212 - RNA, 21 nt, Artificial Sequence
  siRNA sense strand against APCS
gugaucucucucgugccuaca

SEQ ID NO: 213 - RNA, 21 nt, Artificial Sequence
  siRNA sense strand against APCS
ugaucucucucgugccuacag

SEQ ID NO: 214 - RNA, 21 nt, Artificial Sequence
  siRNA sense strand against APCS
gaucucucucgugccuacagc

SEQ ID NO: 215 - RNA, 21 nt, Artificial Sequence
  siRNA sense strand against APCS
cucucgugccuacagccucuu

SEQ ID NO: 216 - RNA, 21 nt, Artificial Sequence
  siRNA sense strand against APCS
ucucgugccuacagccucuuc

SEQ ID NO: 217 - RNA, 21 nt, Artificial Sequence
  siRNA sense strand against APCS
cucgugccuacagccucuucu

SEQ ID NO: 218 - RNA, 21 nt, Artificial Sequence
  siRNA sense strand against APCS
cgugccuacagccucuucucc

SEQ ID NO: 219 - RNA, 21 nt, Artificial Sequence
  siRNA sense strand against APCS
gugccuacagccucuucuccu

SEQ ID NO: 220 - RNA, 21 nt, Artificial Sequence
  siRNA sense strand against APCS
gccuacagccucuucuccuac

SEQ ID NO: 221 - RNA, 21 nt, Artificial Sequence
  siRNA sense strand against APCS
ccuacagccucuucuccuaca

SEQ ID NO: 222 - RNA, 21 nt, Artificial Sequence
  siRNA sense strand against APCS
cuacagccucuucuccuacaa

SEQ ID NO: 223 - RNA, 21 nt, Artificial Sequence
  siRNA sense strand against APCS
uacagccucuucuccuacaau

SEQ ID NO: 224 - RNA, 21 nt, Artificial Sequence
  siRNA sense strand against APCS
acagccucuucuccuacaaua

SEQ ID NO: 225 - RNA, 21 nt, Artificial Sequence
  siRNA sense strand against APCS
cagccucuucuccuacaauac

SEQ ID NO: 226 - RNA, 21 nt, Artificial Sequence
  siRNA sense strand against APCS
agccucuucuccuacaauacc

SEQ ID NO: 227 - RNA, 21 nt, Artificial Sequence
  siRNA sense strand against APCS
gccucuucuccuacaauaccc

SEQ ID NO: 228 - RNA, 21 nt, Artificial Sequence
  siRNA sense strand against APCS
ccucuucuccuacaauaccca

SEQ ID NO: 229 - RNA, 21 nt, Artificial Sequence
  siRNA sense strand against APCS
ucuucuccuacaauacccaag

SEQ ID NO: 230 - RNA, 21 nt, Artificial Sequence
  siRNA sense strand against APCS
ucuccuacaauacccaaggca

SEQ ID NO: 231 - RNA, 21 nt, Artificial Sequence
  siRNA sense strand against APCS
cuccuacaauacccaaggcag

SEQ ID NO: 232 - RNA, 21 nt, Artificial Sequence
  siRNA sense strand against APCS
uccuacaauacccaaggcagg

SEQ ID NO: 233 - RNA, 21 nt, Artificial Sequence
  siRNA sense strand against APCS
ccuacaauacccaaggcaggg

SEQ ID NO: 234 - RNA, 21 nt, Artificial Sequence
  siRNA sense strand against APCS
cuacaauacccaaggcaggga

SEQ ID NO: 235 - RNA, 21 nt, Artificial Sequence
  siRNA sense strand against APCS
caauacccaaggcagggauaa

SEQ ID NO: 236 - RNA, 21 nt, Artificial Sequence
  siRNA sense strand against APCS
auacccaaggcagggauaaug

SEQ ID NO: 237 - RNA, 21 nt, Artificial Sequence
  siRNA sense strand against APCS
uacccaaggcagggauaauga

SEQ ID NO: 238 - RNA, 21 nt, Artificial Sequence
  siRNA sense strand against APCS
ccaaggcagggauaaugagcu

SEQ ID NO: 239 - RNA, 21 nt, Artificial Sequence
  siRNA sense strand against APCS
aaggcagggauaaugagcuac

SEQ ID NO: 240 - RNA, 21 nt, Artificial Sequence
  siRNA sense strand against APCS
aggcagggauaaugagcuacu

SEQ ID NO: 241 - RNA, 21 nt, Artificial Sequence
  siRNA sense strand against APCS
gcagggauaaugagcuacuag

SEQ ID NO: 242 - RNA, 21 nt, Artificial Sequence
  siRNA sense strand against APCS
cagggauaaugagcuacuagu

SEQ ID NO: 243 - RNA, 21 nt, Artificial Sequence
  siRNA sense strand against APCS
agggauaaugagcuacuaguu

SEQ ID NO: 244 - RNA, 21 nt, Artificial Sequence
  siRNA sense strand against APCS
gggauaaugagcuacuaguuu

SEQ ID NO: 245 - RNA, 21 nt, Artificial Sequence
  siRNA sense strand against APCS
ggauaaugagcuacuaguuua

SEQ ID NO: 246 - RNA, 21 nt, Artificial Sequence
  siRNA sense strand against APCS
gauaaugagcuacuaguuuau

SEQ ID NO: 247 - RNA, 21 nt, Artificial Sequence
  siRNA sense strand against APCS
auaaugagcuacuaguuuaua

SEQ ID NO: 248 - RNA, 21 nt, Artificial Sequence
  siRNA sense strand against APCS
uaaugagcuacuaguuuauaa

SEQ ID NO: 249 - RNA, 21 nt, Artificial Sequence
  siRNA sense strand against APCS
augagcuacuaguuuauaaag

SEQ ID NO: 250 - RNA, 21 nt, Artificial Sequence
  siRNA sense strand against APCS
ugagcuacuaguuuauaaaga

SEQ ID NO: 251 - RNA, 21 nt, Artificial Sequence
  siRNA sense strand against APCS
gagcuacuaguuuauaaagaa

SEQ ID NO: 252 - RNA, 21 nt, Artificial Sequence
  siRNA sense strand against APCS
agcuacuaguuuauaaagaaa

SEQ ID NO: 253 - RNA, 21 nt, Artificial Sequence
  siRNA sense strand against APCS
gcuacuaguuuauaaagaaag

SEQ ID NO: 254 - RNA, 21 nt, Artificial Sequence
  siRNA sense strand against APCS
cuacuaguuuauaaagaaaga

SEQ ID NO: 255 - RNA, 21 nt, Artificial Sequence
  siRNA sense strand against APCS
aguuuauaaagaaagaguugg

SEQ ID NO: 256 - RNA, 21 nt, Artificial Sequence
  siRNA sense strand against APCS
aagaaagaguuggagaguaua

SEQ ID NO: 257 - RNA, 21 nt, Artificial Sequence
  siRNA sense strand against APCS
agaaagaguuggagaguauag

SEQ ID NO: 258 - RNA, 21 nt, Artificial Sequence
  siRNA sense strand against APCS
gaaagaguuggagaguauagu

SEQ ID NO: 259 - RNA, 21 nt, Artificial Sequence
  siRNA sense strand against APCS
aagaguuggagaguauagucu

SEQ ID NO: 260 - RNA, 21 nt, Artificial Sequence
  siRNA sense strand against APCS
agaguuggagaguauagucua

SEQ ID NO: 261 - RNA, 21 nt, Artificial Sequence
  siRNA sense strand against APCS
gaguuggagaguauagucuau

SEQ ID NO: 262 - RNA, 21 nt, Artificial Sequence
  siRNA sense strand against APCS
aguuggagaguauagucuaua

SEQ ID NO: 263 - RNA, 21 nt, Artificial Sequence
  siRNA sense strand against APCS
guuggagaguauagucuauac

SEQ ID NO: 264 - RNA, 21 nt, Artificial Sequence
  siRNA sense strand against APCS
uuggagaguauagucuauaca

SEQ ID NO: 265 - RNA, 21 nt, Artificial Sequence
  siRNA sense strand against APCS
uggagaguauagucuauacau

SEQ ID NO: 266 - RNA, 21 nt, Artificial Sequence
  siRNA sense strand against APCS
ggagaguauagucuauacauu

SEQ ID NO: 267 - RNA, 21 nt, Artificial Sequence
  siRNA sense strand against APCS
gagaguauagucuauacauug

SEQ ID NO: 268 - RNA, 21 nt, Artificial Sequence
  siRNA sense strand against APCS
agaguauagucuauacauugg

SEQ ID NO: 269 - RNA, 21 nt, Artificial Sequence
  siRNA sense strand against APCS
gaguauagucuauacauugga

SEQ ID NO: 270 - RNA, 21 nt, Artificial Sequence
  siRNA sense strand against APCS
aguauagucuauacauuggaa

SEQ ID NO: 271 - RNA, 21 nt, Artificial Sequence
  siRNA sense strand against APCS
guauagucuauacauuggaag

SEQ ID NO: 272 - RNA, 21 nt, Artificial Sequence
  siRNA sense strand against APCS
gucuauacauuggaagacaca

SEQ ID NO: 273 - RNA, 21 nt, Artificial Sequence
  siRNA sense strand against APCS
cuauacauuggaagacacaaa

SEQ ID NO: 274 - RNA, 21 nt, Artificial Sequence
  siRNA sense strand against APCS
uauacauuggaagacacaaag

SEQ ID NO: 275 - RNA, 21 nt, Artificial Sequence
  siRNA sense strand against APCS
auacauuggaagacacaaagu

SEQ ID NO: 276 - RNA, 21 nt, Artificial Sequence
  siRNA sense strand against APCS
acauuggaagacacaaaguua

SEQ ID NO: 277 - RNA, 21 nt, Artificial Sequence
  siRNA sense strand against APCS
cauuggaagacacaaaguuac

SEQ ID NO: 278 - RNA, 21 nt, Artificial Sequence
  siRNA sense strand against APCS
auuggaagacacaaaguuaca

SEQ ID NO: 279 - RNA, 21 nt, Artificial Sequence
  siRNA sense strand against APCS
uggaagacacaaaguuacauc

SEQ ID NO: 280 - RNA, 21 nt, Artificial Sequence
  siRNA sense strand against APCS
ggaagacacaaaguuacaucc

SEQ ID NO: 281 - RNA, 21 nt, Artificial Sequence
  siRNA sense strand against APCS
gaagacacaaaguuacaucca

SEQ ID NO: 282 - RNA, 21 nt, Artificial Sequence
  siRNA sense strand against APCS
aagacacaaaguuacauccaa

SEQ ID NO: 283 - RNA, 21 nt, Artificial Sequence
  siRNA sense strand against APCS
agacacaaaguuacauccaaa

SEQ ID NO: 284 - RNA, 21 nt, Artificial Sequence
  siRNA sense strand against APCS
gacacaaaguuacauccaaag

SEQ ID NO: 285 - RNA, 21 nt, Artificial Sequence
  siRNA sense strand against APCS
acacaaaguuacauccaaagu

SEQ ID NO: 286 - RNA, 21 nt, Artificial Sequence
  siRNA sense strand against APCS
cacaaaguuacauccaaaguu

SEQ ID NO: 287 - RNA, 21 nt, Artificial Sequence
  siRNA sense strand against APCS
caaaguuacauccaaaguuau

SEQ ID NO: 288 - RNA, 21 nt, Artificial Sequence
  siRNA sense strand against APCS
aaaguuacauccaaaguuauc

SEQ ID NO: 289 - RNA, 21 nt, Artificial Sequence
  siRNA sense strand against APCS
aaguuacauccaaaguuaucg

SEQ ID NO: 290 - RNA, 21 nt, Artificial Sequence
  siRNA sense strand against APCS
aguuacauccaaaguuaucga

SEQ ID NO: 291 - RNA, 21 nt, Artificial Sequence
  siRNA sense strand against APCS
guuacauccaaaguuaucgaa

SEQ ID NO: 292 - RNA, 21 nt, Artificial Sequence
  siRNA sense strand against APCS
uuacauccaaaguuaucgaaa

SEQ ID NO: 293 - RNA, 21 nt, Artificial Sequence
  siRNA sense strand against APCS
uacauccaaaguuaucgaaaa

SEQ ID NO: 294 - RNA, 21 nt, Artificial Sequence
  siRNA sense strand against APCS
acauccaaaguuaucgaaaag

SEQ ID NO: 295 - RNA, 21 nt, Artificial Sequence
  siRNA sense strand against APCS
cauccaaaguuaucgaaaagu

SEQ ID NO: 296 - RNA, 21 nt, Artificial Sequence
  siRNA sense strand against APCS
auccaaaguuaucgaaaaguu

SEQ ID NO: 297 - RNA, 21 nt, Artificial Sequence
  siRNA sense strand against APCS
uccaaaguuaucgaaaaguuc

SEQ ID NO: 298 - RNA, 21 nt, Artificial Sequence
  siRNA sense strand against APCS
ccaaaguuaucgaaaaguucc

SEQ ID NO: 299 - RNA, 21 nt, Artificial Sequence
  siRNA sense strand against APCS
caaaguuaucgaaaaguuccc

SEQ ID NO: 300 - RNA, 21 nt, Artificial Sequence
  siRNA sense strand against APCS
cgaaaaguucccggcuccagu

SEQ ID NO: 301 - RNA, 21 nt, Artificial Sequence
  siRNA sense strand against APCS
aaaaguucccggcuccagugc

SEQ ID NO: 302 - RNA, 21 nt, Artificial Sequence
  siRNA sense strand against APCS
cccggcuccagugcacaucug

SEQ ID NO: 303 - RNA, 21 nt, Artificial Sequence
  siRNA sense strand against APCS
cggcuccagugcacaucugug

SEQ ID NO: 304 - RNA, 21 nt, Artificial Sequence
  siRNA sense strand against APCS
ggcuccagugcacaucugugu

SEQ ID NO: 305 - RNA, 21 nt, Artificial Sequence
  siRNA sense strand against APCS
gcuccagugcacaucugugug

SEQ ID NO: 306 - RNA, 21 nt, Artificial Sequence
  siRNA sense strand against APCS
cuccagugcacaucuguguga

SEQ ID NO: 307 - RNA, 21 nt, Artificial Sequence
  siRNA sense strand against APCS
ccagugcacaucugugugagc

SEQ ID NO: 308 - RNA, 21 nt, Artificial Sequence
  siRNA sense strand against APCS
gugcacaucugugugagcugg

SEQ ID NO: 309 - RNA, 21 nt, Artificial Sequence
  siRNA sense strand against APCS
gcacaucugugugagcuggga

SEQ ID NO: 310 - RNA, 21 nt, Artificial Sequence
  siRNA sense strand against APCS
acaucugugugagcugggagu

SEQ ID NO: 311 - RNA, 21 nt, Artificial Sequence
  siRNA sense strand against APCS
aucugugugagcugggagucc

SEQ ID NO: 312 - RNA, 21 nt, Artificial Sequence
  siRNA sense strand against APCS
ugugugagcugggaguccuca

SEQ ID NO: 313 - RNA, 21 nt, Artificial Sequence
  siRNA sense strand against APCS
gugugagcugggaguccucau

SEQ ID NO: 314 - RNA, 21 nt, Artificial Sequence
  siRNA sense strand against APCS
agcugggaguccucaucaggu

SEQ ID NO: 315 - RNA, 21 nt, Artificial Sequence
  siRNA sense strand against APCS
gcugggaguccucaucaggua

SEQ ID NO: 316 - RNA, 21 nt, Artificial Sequence
  siRNA sense strand against APCS
cugggaguccucaucagguau

SEQ ID NO: 317 - RNA, 21 nt, Artificial Sequence
  siRNA sense strand against APCS
ugggaguccucaucagguauu

SEQ ID NO: 318 - RNA, 21 nt, Artificial Sequence
  siRNA sense strand against APCS
gggaguccucaucagguauug

SEQ ID NO: 319 - RNA, 21 nt, Artificial Sequence
  siRNA sense strand against APCS
ggaguccucaucagguauugc

SEQ ID NO: 320 - RNA, 21 nt, Artificial Sequence
  siRNA sense strand against APCS
gaguccucaucagguauugcu

SEQ ID NO: 321 - RNA, 21 nt, Artificial Sequence
  siRNA sense strand against APCS
guccucaucagguauugcuga

SEQ ID NO: 322 - RNA, 21 nt, Artificial Sequence
  siRNA sense strand against APCS
uccucaucagguauugcugaa

SEQ ID NO: 323 - RNA, 21 nt, Artificial Sequence
  siRNA sense strand against APCS
ccucaucagguauugcugaau

SEQ ID NO: 324 - RNA, 21 nt, Artificial Sequence
  siRNA sense strand against APCS
cucaucagguauugcugaauu

SEQ ID NO: 325 - RNA, 21 nt, Artificial Sequence
  siRNA sense strand against APCS
ucaucagguauugcugaauuu

SEQ ID NO: 326 - RNA, 21 nt, Artificial Sequence
  siRNA sense strand against APCS
caucagguauugcugaauuuu

SEQ ID NO: 327 - RNA, 21 nt, Artificial Sequence
  siRNA sense strand against APCS
aucagguauugcugaauuuug

SEQ ID NO: 328 - RNA, 21 nt, Artificial Sequence
  siRNA sense strand against APCS
ucagguauugcugaauuuugg

SEQ ID NO: 329 - RNA, 21 nt, Artificial Sequence
  siRNA sense strand against APCS
cagguauugcugaauuuugga

SEQ ID NO: 330 - RNA, 21 nt, Artificial Sequence
  siRNA sense strand against APCS
agguauugcugaauuuuggau

SEQ ID NO: 331 - RNA, 21 nt, Artificial Sequence
  siRNA sense strand against APCS
gguauugcugaauuuuggauc

SEQ ID NO: 332 - RNA, 21 nt, Artificial Sequence
  siRNA sense strand against APCS
guauugcugaauuuuggauca

SEQ ID NO: 333 - RNA, 21 nt, Artificial Sequence
  siRNA sense strand against APCS
auugcugaauuuuggaucaau

SEQ ID NO: 334 - RNA, 21 nt, Artificial Sequence
  siRNA sense strand against APCS
ugcugaauuuuggaucaaugg

SEQ ID NO: 335 - RNA, 21 nt, Artificial Sequence
  siRNA sense strand against APCS
gcugaauuuuggaucaauggg

SEQ ID NO: 336 - RNA, 21 nt, Artificial Sequence
  siRNA sense strand against APCS
cugaauuuuggaucaauggga

SEQ ID NO: 337 - RNA, 21 nt, Artificial Sequence
  siRNA sense strand against APCS
gaauuuuggaucaaugggaca

SEQ ID NO: 338 - RNA, 21 nt, Artificial Sequence
  siRNA sense strand against APCS
ggaucaaugggacaccuuugg

SEQ ID NO: 339 - RNA, 21 nt, Artificial Sequence
  siRNA sense strand against APCS
caaugggacaccuuuggugaa

SEQ ID NO: 340 - RNA, 21 nt, Artificial Sequence
  siRNA sense strand against APCS
aaugggacaccuuuggugaaa

SEQ ID NO: 341 - RNA, 21 nt, Artificial Sequence
  siRNA sense strand against APCS
augggacaccuuuggugaaaa

SEQ ID NO: 342 - RNA, 21 nt, Artificial Sequence
  siRNA sense strand against APCS
ugggacaccuuuggugaaaaa

SEQ ID NO: 343 - RNA, 21 nt, Artificial Sequence
  siRNA sense strand against APCS
gggacaccuuuggugaaaaag

SEQ ID NO: 344 - RNA, 21 nt, Artificial Sequence
  siRNA sense strand against APCS
ggacaccuuuggugaaaaagg

SEQ ID NO: 345 - RNA, 21 nt, Artificial Sequence
  siRNA sense strand against APCS
accuuuggugaaaaagggucu

SEQ ID NO: 346 - RNA, 21 nt, Artificial Sequence
  siRNA sense strand against APCS
ccuuuggugaaaaagggucug

SEQ ID NO: 347 - RNA, 21 nt, Artificial Sequence
  siRNA sense strand against APCS
cuuuggugaaaaagggucugc

SEQ ID NO: 348 - RNA, 21 nt, Artificial Sequence
  siRNA sense strand against APCS
ggugaaaaagggucugcgaca

SEQ ID NO: 349 - RNA, 21 nt, Artificial Sequence
  siRNA sense strand against APCS
gugaaaaagggucugcgacag

SEQ ID NO: 350 - RNA, 21 nt, Artificial Sequence
  siRNA sense strand against APCS
ugaaaaagggucugcgacagg

SEQ ID NO: 351 - RNA, 21 nt, Artificial Sequence
  siRNA sense strand against APCS
gaaaaagggucugcgacaggg

SEQ ID NO: 352 - RNA, 21 nt, Artificial Sequence
  siRNA sense strand against APCS
aaagggucugcgacaggguua

SEQ ID NO: 353 - RNA, 21 nt, Artificial Sequence
  siRNA sense strand against APCS
aagggucugcgacaggguuac

SEQ ID NO: 354 - RNA, 21 nt, Artificial Sequence
  siRNA sense strand against APCS
agggucugcgacaggguuacu

SEQ ID NO: 355 - RNA, 21 nt, Artificial Sequence
  siRNA sense strand against APCS
gggucugcgacaggguuacuu

SEQ ID NO: 356 - RNA, 21 nt, Artificial Sequence
  siRNA sense strand against APCS
ggucugcgacaggguuacuuu

SEQ ID NO: 357 - RNA, 21 nt, Artificial Sequence
  siRNA sense strand against APCS
gucugcgacaggguuacuuug

SEQ ID NO: 358 - RNA, 21 nt, Artificial Sequence
  siRNA sense strand against APCS
ucugcgacaggguuacuuugu

SEQ ID NO: 359 - RNA, 21 nt, Artificial Sequence
  siRNA sense strand against APCS
cugcgacaggguuacuuugua

SEQ ID NO: 360 - RNA, 21 nt, Artificial Sequence
  siRNA sense strand against APCS
ugcgacaggguuacuuuguag

SEQ ID NO: 361 - RNA, 21 nt, Artificial Sequence
  siRNA sense strand against APCS
gcgacaggguuacuuuguaga

SEQ ID NO: 362 - RNA, 21 nt, Artificial Sequence
  siRNA sense strand against APCS
cgacaggguuacuuuguagaa

SEQ ID NO: 363 - RNA, 21 nt, Artificial Sequence
  siRNA sense strand against APCS
gacaggguuacuuuguagaag

SEQ ID NO: 364 - RNA, 21 nt, Artificial Sequence
  siRNA sense strand against APCS
acaggguuacuuuguagaagc

SEQ ID NO: 365 - RNA, 21 nt, Artificial Sequence
  siRNA sense strand against APCS
caggguuacuuuguagaagcu

SEQ ID NO: 366 - RNA, 21 nt, Artificial Sequence
  siRNA sense strand against APCS
aggguuacuuuguagaagcuc

SEQ ID NO: 367 - RNA, 21 nt, Artificial Sequence
  siRNA sense strand against APCS
ggguuacuuuguagaagcuca

SEQ ID NO: 368 - RNA, 21 nt, Artificial Sequence
  siRNA sense strand against APCS
gguuacuuuguagaagcucag

SEQ ID NO: 369 - RNA, 21 nt, Artificial Sequence
  siRNA sense strand against APCS
guuacuuuguagaagcucagc

SEQ ID NO: 370 - RNA, 21 nt, Artificial Sequence
  siRNA sense strand against APCS
agaagcucagcccaagauugu

SEQ ID NO: 371 - RNA, 21 nt, Artificial Sequence
  siRNA sense strand against APCS
gaagcucagcccaagauuguc

SEQ ID NO: 372 - RNA, 21 nt, Artificial Sequence
  siRNA sense strand against APCS
aagcucagcccaagauugucc

SEQ ID NO: 373 - RNA, 21 nt, Artificial Sequence
  siRNA sense strand against APCS
agcucagcccaagauuguccu

SEQ ID NO: 374 - RNA, 21 nt, Artificial Sequence
  siRNA sense strand against APCS
cucagcccaagauuguccugg

SEQ ID NO: 375 - RNA, 21 nt, Artificial Sequence
  siRNA sense strand against APCS
agcccaagauuguccuggggc

SEQ ID NO: 376 - RNA, 21 nt, Artificial Sequence
  siRNA sense strand against APCS
ccaagauuguccuggggcagg

SEQ ID NO: 377 - RNA, 21 nt, Artificial Sequence
  siRNA sense strand against APCS
caagauuguccuggggcagga

SEQ ID NO: 378 - RNA, 21 nt, Artificial Sequence
  siRNA sense strand against APCS
agauuguccuggggcaggaac

SEQ ID NO: 379 - RNA, 21 nt, Artificial Sequence
  siRNA sense strand against APCS
gauuguccuggggcaggaaca

SEQ ID NO: 380 - RNA, 21 nt, Artificial Sequence
  siRNA sense strand against APCS
uuguccuggggcaggaacagg

SEQ ID NO: 381 - RNA, 21 nt, Artificial Sequence
  siRNA sense strand against APCS
uccuggggcaggaacaggauu

SEQ ID NO: 382 - RNA, 21 nt, Artificial Sequence
  siRNA sense strand against APCS
cuggggcaggaacaggauucc

SEQ ID NO: 383 - RNA, 21 nt, Artificial Sequence
  siRNA sense strand against APCS
uggggcaggaacaggauuccu

SEQ ID NO: 384 - RNA, 21 nt, Artificial Sequence
  siRNA sense strand against APCS
ggggcaggaacaggauuccua

SEQ ID NO: 385 - RNA, 21 nt, Artificial Sequence
  siRNA sense strand against APCS
ggcaggaacaggauuccuaug

SEQ ID NO: 386 - RNA, 21 nt, Artificial Sequence
  siRNA sense strand against APCS
gcaggaacaggauuccuaugg

SEQ ID NO: 387 - RNA, 21 nt, Artificial Sequence
  siRNA sense strand against APCS
caggaacaggauuccuauggg

SEQ ID NO: 388 - RNA, 21 nt, Artificial Sequence
  siRNA sense strand against APCS
ggaacaggauuccuauggggg

SEQ ID NO: 389 - RNA, 21 nt, Artificial Sequence
  siRNA sense strand against APCS
gaacaggauuccuaugggggc

SEQ ID NO: 390 - RNA, 21 nt, Artificial Sequence
  siRNA sense strand against APCS
acaggauuccuaugggggcaa

SEQ ID NO: 391 - RNA, 21 nt, Artificial Sequence
  siRNA sense strand against APCS
caggauuccuaugggggcaag

SEQ ID NO: 392 - RNA, 21 nt, Artificial Sequence
  siRNA sense strand against APCS
ggauuccuaugggggcaaguu

SEQ ID NO: 393 - RNA, 21 nt, Artificial Sequence
  siRNA sense strand against APCS
gauuccuaugggggcaaguuu

SEQ ID NO: 394 - RNA, 21 nt, Artificial Sequence
  siRNA sense strand against APCS
auuccuaugggggcaaguuug

SEQ ID NO: 395 - RNA, 21 nt, Artificial Sequence
  siRNA sense strand against APCS
uuccuaugggggcaaguuuga

SEQ ID NO: 396 - RNA, 21 nt, Artificial Sequence
  siRNA sense strand against APCS
uccuaugggggcaaguuugau

SEQ ID NO: 397 - RNA, 21 nt, Artificial Sequence
  siRNA sense strand against APCS
ccuaugggggcaaguuugaua

SEQ ID NO: 398 - RNA, 21 nt, Artificial Sequence
  siRNA sense strand against APCS
cuaugggggcaaguuugauag

SEQ ID NO: 399 - RNA, 21 nt, Artificial Sequence
  siRNA sense strand against APCS
uaugggggcaaguuugauagg

SEQ ID NO: 400 - RNA, 21 nt, Artificial Sequence
  siRNA sense strand against APCS
gggggcaaguuugauaggagc

SEQ ID NO: 401 - RNA, 21 nt, Artificial Sequence
  siRNA sense strand against APCS
ggggcaaguuugauaggagcc

SEQ ID NO: 402 - RNA, 21 nt, Artificial Sequence
  siRNA sense strand against APCS
gggcaaguuugauaggagcca

SEQ ID NO: 403 - RNA, 21 nt, Artificial Sequence
  siRNA sense strand against APCS
ggcaaguuugauaggagccag

SEQ ID NO: 404 - RNA, 21 nt, Artificial Sequence
  siRNA sense strand against APCS
gcaaguuugauaggagccagu

SEQ ID NO: 405 - RNA, 21 nt, Artificial Sequence
  siRNA sense strand against APCS
caaguuugauaggagccaguc

SEQ ID NO: 406 - RNA, 21 nt, Artificial Sequence
  siRNA sense strand against APCS
aaguuugauaggagccagucc

SEQ ID NO: 407 - RNA, 21 nt, Artificial Sequence
  siRNA sense strand against APCS
uugauaggagccaguccuuug

SEQ ID NO: 408 - RNA, 21 nt, Artificial Sequence
  siRNA sense strand against APCS
ugauaggagccaguccuuugu

SEQ ID NO: 409 - RNA, 21 nt, Artificial Sequence
  siRNA sense strand against APCS
gauaggagccaguccuuugug

SEQ ID NO: 410 - RNA, 21 nt, Artificial Sequence
  siRNA sense strand against APCS
auaggagccaguccuuugugg

SEQ ID NO: 411 - RNA, 21 nt, Artificial Sequence
  siRNA sense strand against APCS
aggagccaguccuuuguggga

SEQ ID NO: 412 - RNA, 21 nt, Artificial Sequence
  siRNA sense strand against APCS
ggagccaguccuuugugggag

SEQ ID NO: 413 - RNA, 21 nt, Artificial Sequence
  siRNA sense strand against APCS
gagccaguccuuugugggaga

SEQ ID NO: 414 - RNA, 21 nt, Artificial Sequence
  siRNA sense strand against APCS
agccaguccuuugugggagag

SEQ ID NO: 415 - RNA, 21 nt, Artificial Sequence
  siRNA sense strand against APCS
gccaguccuuugugggagaga

SEQ ID NO: 416 - RNA, 21 nt, Artificial Sequence
  siRNA sense strand against APCS
ccaguccuuugugggagagau

SEQ ID NO: 417 - RNA, 21 nt, Artificial Sequence
  siRNA sense strand against APCS
caguccuuugugggagagauu

SEQ ID NO: 418 - RNA, 21 nt, Artificial Sequence
  siRNA sense strand against APCS
aguccuuugugggagagauug

SEQ ID NO: 419 - RNA, 21 nt, Artificial Sequence
  siRNA sense strand against APCS
guccuuugugggagagauugg

SEQ ID NO: 420 - RNA, 21 nt, Artificial Sequence
  siRNA sense strand against APCS
uccuuugugggagagauuggg

SEQ ID NO: 421 - RNA, 21 nt, Artificial Sequence
  siRNA sense strand against APCS
ccuuugugggagagauugggg

SEQ ID NO: 422 - RNA, 21 nt, Artificial Sequence
  siRNA sense strand against APCS
cuuugugggagagauugggga

SEQ ID NO: 423 - RNA, 21 nt, Artificial Sequence
  siRNA sense strand against APCS
uugugggagagauuggggauu

SEQ ID NO: 424 - RNA, 21 nt, Artificial Sequence
  siRNA sense strand against APCS
ugugggagagauuggggauuu

SEQ ID NO: 425 - RNA, 21 nt, Artificial Sequence
  siRNA sense strand against APCS
gugggagagauuggggauuug

SEQ ID NO: 426 - RNA, 21 nt, Artificial Sequence
  siRNA sense strand against APCS
ugggagagauuggggauuugu

SEQ ID NO: 427 - RNA, 21 nt, Artificial Sequence
  siRNA sense strand against APCS
gggagagauuggggauuugua

SEQ ID NO: 428 - RNA, 21 nt, Artificial Sequence
  siRNA sense strand against APCS
ggagagauuggggauuuguac

SEQ ID NO: 429 - RNA, 21 nt, Artificial Sequence
  siRNA sense strand against APCS
gagagauuggggauuuguaca

SEQ ID NO: 430 - RNA, 21 nt, Artificial Sequence
  siRNA sense strand against APCS
agagauuggggauuuguacau

SEQ ID NO: 431 - RNA, 21 nt, Artificial Sequence
  siRNA sense strand against APCS
gagauuggggauuuguacaug

SEQ ID NO: 432 - RNA, 21 nt, Artificial Sequence
  siRNA sense strand against APCS
agauuggggauuuguacaugu

SEQ ID NO: 433 - RNA, 21 nt, Artificial Sequence
  siRNA sense strand against APCS
ggggauuuguacaugugggac

SEQ ID NO: 434 - RNA, 21 nt, Artificial Sequence
  siRNA sense strand against APCS
gggauuuguacaugugggacu

SEQ ID NO: 435 - RNA, 21 nt, Artificial Sequence
  siRNA sense strand against APCS
ggauuuguacaugugggacuc

SEQ ID NO: 436 - RNA, 21 nt, Artificial Sequence
  siRNA sense strand against APCS
gauuuguacaugugggacucu

SEQ ID NO: 437 - RNA, 21 nt, Artificial Sequence
  siRNA sense strand against APCS
uguacaugugggacucugugc

SEQ ID NO: 438 - RNA, 21 nt, Artificial Sequence
  siRNA sense strand against APCS
guacaugugggacucugugcu

SEQ ID NO: 439 - RNA, 21 nt, Artificial Sequence
  siRNA sense strand against APCS
acaugugggacucugugcugc

SEQ ID NO: 440 - RNA, 21 nt, Artificial Sequence
  siRNA sense strand against APCS
gggacucugugcugcccccag

SEQ ID NO: 441 - RNA, 21 nt, Artificial Sequence
  siRNA sense strand against APCS
ggacucugugcugcccccaga

SEQ ID NO: 442 - RNA, 21 nt, Artificial Sequence
  siRNA sense strand against APCS
acucugugcugcccccagaaa

SEQ ID NO: 443 - RNA, 21 nt, Artificial Sequence
  siRNA sense strand against APCS
cucugugcugcccccagaaaa

SEQ ID NO: 444 - RNA, 21 nt, Artificial Sequence
  siRNA sense strand against APCS
cugugcugcccccagaaaaua

SEQ ID NO: 445 - RNA, 21 nt, Artificial Sequence
  siRNA sense strand against APCS
ugugcugcccccagaaaauau

SEQ ID NO: 446 - RNA, 21 nt, Artificial Sequence
  siRNA sense strand against APCS
gugcugcccccagaaaauauc

SEQ ID NO: 447 - RNA, 21 nt, Artificial Sequence
  siRNA sense strand against APCS
gcugcccccagaaaauauccu

SEQ ID NO: 448 - RNA, 21 nt, Artificial Sequence
  siRNA sense strand against APCS
cccccagaaaauauccugucu

SEQ ID NO: 449 - RNA, 21 nt, Artificial Sequence
  siRNA sense strand against APCS
cccagaaaauauccugucugc

SEQ ID NO: 450 - RNA, 21 nt, Artificial Sequence
  siRNA sense strand against APCS
ccagaaaauauccugucugcc

SEQ ID NO: 451 - RNA, 21 nt, Artificial Sequence
  siRNA sense strand against APCS
cagaaaauauccugucugccu

SEQ ID NO: 452 - RNA, 21 nt, Artificial Sequence
  siRNA sense strand against APCS
gaaaauauccugucugccuau

SEQ ID NO: 453 - RNA, 21 nt, Artificial Sequence
  siRNA sense strand against APCS
aaaauauccugucugccuauc

SEQ ID NO: 454 - RNA, 21 nt, Artificial Sequence
  siRNA sense strand against APCS
aaauauccugucugccuauca

SEQ ID NO: 455 - RNA, 21 nt, Artificial Sequence
  siRNA sense strand against APCS
ccugucugccuaucaggguac

SEQ ID NO: 456 - RNA, 21 nt, Artificial Sequence
  siRNA sense strand against APCS
cugucugccuaucaggguacc

SEQ ID NO: 457 - RNA, 21 nt, Artificial Sequence
  siRNA sense strand against APCS
gucugccuaucaggguacccc

SEQ ID NO: 458 - RNA, 21 nt, Artificial Sequence
  siRNA sense strand against APCS
ugccuaucaggguaccccucu

SEQ ID NO: 459 - RNA, 21 nt, Artificial Sequence
  siRNA sense strand against APCS
gccuaucaggguaccccucuc

SEQ ID NO: 460 - RNA, 21 nt, Artificial Sequence
  siRNA sense strand against APCS
ccuaucaggguaccccucucc

SEQ ID NO: 461 - RNA, 21 nt, Artificial Sequence
  siRNA sense strand against APCS
cuaucaggguaccccucuccc

SEQ ID NO: 462 - RNA, 21 nt, Artificial Sequence
  siRNA sense strand against APCS
caggguaccccucucccugcc

SEQ ID NO: 463 - RNA, 21 nt, Artificial Sequence
  siRNA sense strand against APCS
ggguaccccucucccugccaa

SEQ ID NO: 464 - RNA, 21 nt, Artificial Sequence
  siRNA sense strand against APCS
gguaccccucucccugccaau

SEQ ID NO: 465 - RNA, 21 nt, Artificial Sequence
  siRNA sense strand against APCS
guaccccucucccugccaaua

SEQ ID NO: 466 - RNA, 21 nt, Artificial Sequence
  siRNA sense strand against APCS
uaccccucucccugccaauau

SEQ ID NO: 467 - RNA, 21 nt, Artificial Sequence
  siRNA sense strand against APCS
ccccucucccugccaauaucc

SEQ ID NO: 468 - RNA, 21 nt, Artificial Sequence
  siRNA sense strand against APCS
cccucucccugccaauauccu

SEQ ID NO: 469 - RNA, 21 nt, Artificial Sequence
  siRNA sense strand against APCS
cugccaauauccuggacuggc

SEQ ID NO: 470 - RNA, 21 nt, Artificial Sequence
  siRNA sense strand against APCS
ccaauauccuggacuggcagg

SEQ ID NO: 471 - RNA, 21 nt, Artificial Sequence
  siRNA sense strand against APCS
caauauccuggacuggcaggc

SEQ ID NO: 472 - RNA, 21 nt, Artificial Sequence
  siRNA sense strand against APCS
uccuggacuggcaggcucuga

SEQ ID NO: 473 - RNA, 21 nt, Artificial Sequence
  siRNA sense strand against APCS
ccuggacuggcaggcucugaa

SEQ ID NO: 474 - RNA, 21 nt, Artificial Sequence
  siRNA sense strand against APCS
cuggacuggcaggcucugaac

SEQ ID NO: 475 - RNA, 21 nt, Artificial Sequence
  siRNA sense strand against APCS
uggacuggcaggcucugaacu

SEQ ID NO: 476 - RNA, 21 nt, Artificial Sequence
  siRNA sense strand against APCS
ggacuggcaggcucugaacua

SEQ ID NO: 477 - RNA, 21 nt, Artificial Sequence
  siRNA sense strand against APCS
gacuggcaggcucugaacuau

SEQ ID NO: 478 - RNA, 21 nt, Artificial Sequence
  siRNA sense strand against APCS
acuggcaggcucugaacuaug

SEQ ID NO: 479 - RNA, 21 nt, Artificial Sequence
  siRNA sense strand against APCS
cuggcaggcucugaacuauga

SEQ ID NO: 480 - RNA, 21 nt, Artificial Sequence
  siRNA sense strand against APCS
uggcaggcucugaacuaugaa

SEQ ID NO: 481 - RNA, 21 nt, Artificial Sequence
  siRNA sense strand against APCS
ggcaggcucugaacuaugaaa

SEQ ID NO: 482 - RNA, 21 nt, Artificial Sequence
  siRNA sense strand against APCS
gcaggcucugaacuaugaaau

SEQ ID NO: 483 - RNA, 21 nt, Artificial Sequence
  siRNA sense strand against APCS
caggcucugaacuaugaaauc

SEQ ID NO: 484 - RNA, 21 nt, Artificial Sequence
  siRNA sense strand against APCS
aggcucugaacuaugaaauca

SEQ ID NO: 485 - RNA, 21 nt, Artificial Sequence
  siRNA sense strand against APCS
ggcucugaacuaugaaaucag

SEQ ID NO: 486 - RNA, 21 nt, Artificial Sequence
  siRNA sense strand against APCS
gcucugaacuaugaaaucaga

SEQ ID NO: 487 - RNA, 21 nt, Artificial Sequence
  siRNA sense strand against APCS
cucugaacuaugaaaucagag

SEQ ID NO: 488 - RNA, 21 nt, Artificial Sequence
  siRNA sense strand against APCS
ucugaacuaugaaaucagagg

SEQ ID NO: 489 - RNA, 21 nt, Artificial Sequence
  siRNA sense strand against APCS
gaacuaugaaaucagaggaua

SEQ ID NO: 490 - RNA, 21 nt, Artificial Sequence
  siRNA sense strand against APCS
aacuaugaaaucagaggauau

SEQ ID NO: 491 - RNA, 21 nt, Artificial Sequence
  siRNA sense strand against APCS
acuaugaaaucagaggauaug

SEQ ID NO: 492 - RNA, 21 nt, Artificial Sequence
  siRNA sense strand against APCS
cuaugaaaucagaggauaugu

SEQ ID NO: 493 - RNA, 21 nt, Artificial Sequence
  siRNA sense strand against APCS
uaugaaaucagaggauauguc

SEQ ID NO: 494 - RNA, 21 nt, Artificial Sequence
  siRNA sense strand against APCS
ugaaaucagaggauaugucau

SEQ ID NO: 495 - RNA, 21 nt, Artificial Sequence
  siRNA sense strand against APCS
gaaaucagaggauaugucauc

SEQ ID NO: 496 - RNA, 21 nt, Artificial Sequence
  siRNA sense strand against APCS
aaaucagaggauaugucauca

SEQ ID NO: 497 - RNA, 21 nt, Artificial Sequence
  siRNA sense strand against APCS
aaucagaggauaugucaucau

SEQ ID NO: 498 - RNA, 21 nt, Artificial Sequence
  siRNA sense strand against APCS
cagaggauaugucaucaucaa

SEQ ID NO: 499 - RNA, 21 nt, Artificial Sequence
  siRNA sense strand against APCS
agaggauaugucaucaucaaa

SEQ ID NO: 500 - RNA, 21 nt, Artificial Sequence
  siRNA sense strand against APCS
gaggauaugucaucaucaaac

SEQ ID NO: 501 - RNA, 21 nt, Artificial Sequence
  siRNA sense strand against APCS
aggauaugucaucaucaaacc

SEQ ID NO: 502 - RNA, 21 nt, Artificial Sequence
  siRNA sense strand against APCS
ggauaugucaucaucaaaccc

SEQ ID NO: 503 - RNA, 21 nt, Artificial Sequence
  siRNA sense strand against APCS
gauaugucaucaucaaacccu

SEQ ID NO: 504 - RNA, 21 nt, Artificial Sequence
  siRNA sense strand against APCS
augucaucaucaaacccuugg

SEQ ID NO: 505 - RNA, 21 nt, Artificial Sequence
  siRNA sense strand against APCS
caucaucaaacccuuggugug

SEQ ID NO: 506 - RNA, 21 nt, Artificial Sequence
  siRNA sense strand against APCS
ucaucaaacccuugguguggg

SEQ ID NO: 507 - RNA, 21 nt, Artificial Sequence
  siRNA sense strand against APCS
acccuuggugugggucugagg

SEQ ID NO: 508 - RNA, 21 nt, Artificial Sequence
  siRNA sense strand against APCS
cccuuggugugggucugaggu

SEQ ID NO: 509 - RNA, 21 nt, Artificial Sequence
  siRNA sense strand against APCS
ccuuggugugggucugagguc

SEQ ID NO: 510 - RNA, 21 nt, Artificial Sequence
  siRNA sense strand against APCS
cuuggugugggucugaggucu

SEQ ID NO: 511 - RNA, 21 nt, Artificial Sequence
  siRNA sense strand against APCS
uggugugggucugaggucuug

SEQ ID NO: 512 - RNA, 21 nt, Artificial Sequence
  siRNA sense strand against APCS
ggugugggucugaggucuuga

SEQ ID NO: 513 - RNA, 21 nt, Artificial Sequence
  siRNA sense strand against APCS
gugugggucugaggucuugac

SEQ ID NO: 514 - RNA, 21 nt, Artificial Sequence
  siRNA sense strand against APCS
ugugggucugaggucuugacu

SEQ ID NO: 515 - RNA, 21 nt, Artificial Sequence
  siRNA sense strand against APCS
gugggucugaggucuugacuc

SEQ ID NO: 516 - RNA, 21 nt, Artificial Sequence
  siRNA sense strand against APCS
gggucugaggucuugacucaa

SEQ ID NO: 517 - RNA, 21 nt, Artificial Sequence
  siRNA sense strand against APCS
ggucugaggucuugacucaac

SEQ ID NO: 518 - RNA, 21 nt, Artificial Sequence
  siRNA sense strand against APCS
gucugaggucuugacucaacg

SEQ ID NO: 519 - RNA, 21 nt, Artificial Sequence
  siRNA sense strand against APCS
cugaggucuugacucaacgag

SEQ ID NO: 520 - RNA, 21 nt, Artificial Sequence
  siRNA sense strand against APCS
ugaggucuugacucaacgaga

SEQ ID NO: 521 - RNA, 21 nt, Artificial Sequence
  siRNA sense strand against APCS
gaggucuugacucaacgagag

SEQ ID NO: 522 - RNA, 21 nt, Artificial Sequence
  siRNA sense strand against APCS
aggucuugacucaacgagagc

SEQ ID NO: 523 - RNA, 21 nt, Artificial Sequence
  siRNA sense strand against APCS
ggucuugacucaacgagagca

SEQ ID NO: 524 - RNA, 21 nt, Artificial Sequence
  siRNA sense strand against APCS
gucuugacucaacgagagcac

SEQ ID NO: 525 - RNA, 21 nt, Artificial Sequence
  siRNA sense strand against APCS
ucuugacucaacgagagcacu

SEQ ID NO: 526 - RNA, 21 nt, Artificial Sequence
  siRNA sense strand against APCS
cuugacucaacgagagcacuu

SEQ ID NO: 527 - RNA, 21 nt, Artificial Sequence
  siRNA sense strand against APCS
uugacucaacgagagcacuug

SEQ ID NO: 528 - RNA, 21 nt, Artificial Sequence
  siRNA sense strand against APCS
ugacucaacgagagcacuuga

SEQ ID NO: 529 - RNA, 21 nt, Artificial Sequence
  siRNA sense strand against APCS
gacucaacgagagcacuugaa

SEQ ID NO: 530 - RNA, 21 nt, Artificial Sequence
  siRNA sense strand against APCS
acucaacgagagcacuugaaa

SEQ ID NO: 531 - RNA, 21 nt, Artificial Sequence
  siRNA sense strand against APCS
cucaacgagagcacuugaaaa

SEQ ID NO: 532 - RNA, 21 nt, Artificial Sequence
  siRNA sense strand against APCS
ucaacgagagcacuugaaaau

SEQ ID NO: 533 - RNA, 21 nt, Artificial Sequence
  siRNA sense strand against APCS
caacgagagcacuugaaaaug

SEQ ID NO: 534 - RNA, 21 nt, Artificial Sequence
  siRNA sense strand against APCS
aacgagagcacuugaaaauga

SEQ ID NO: 535 - RNA, 21 nt, Artificial Sequence
  siRNA sense strand against APCS
acgagagcacuugaaaaugaa

SEQ ID NO: 536 - RNA, 21 nt, Artificial Sequence
  siRNA sense strand against APCS
cgagagcacuugaaaaugaaa

SEQ ID NO: 537 - RNA, 21 nt, Artificial Sequence
  siRNA sense strand against APCS
gagagcacuugaaaaugaaau

SEQ ID NO: 538 - RNA, 21 nt, Artificial Sequence
  siRNA sense strand against APCS
agagcacuugaaaaugaaaug

SEQ ID NO: 539 - RNA, 21 nt, Artificial Sequence
  siRNA sense strand against APCS
gagcacuugaaaaugaaauga

SEQ ID NO: 540 - RNA, 21 nt, Artificial Sequence
  siRNA sense strand against APCS
agcacuugaaaaugaaaugac

SEQ ID NO: 541 - RNA, 21 nt, Artificial Sequence
  siRNA sense strand against APCS
gcacuugaaaaugaaaugacu

SEQ ID NO: 542 - RNA, 21 nt, Artificial Sequence
  siRNA sense strand against APCS
cacuugaaaaugaaaugacug

SEQ ID NO: 543 - RNA, 21 nt, Artificial Sequence
  siRNA sense strand against APCS
acuugaaaaugaaaugacugu

SEQ ID NO: 544 - RNA, 21 nt, Artificial Sequence
  siRNA sense strand against APCS
cuugaaaaugaaaugacuguc

SEQ ID NO: 545 - RNA, 21 nt, Artificial Sequence
  siRNA sense strand against APCS
uugaaaaugaaaugacugucu

SEQ ID NO: 546 - RNA, 21 nt, Artificial Sequence
  siRNA sense strand against APCS
ugaaaaugaaaugacugucua

SEQ ID NO: 547 - RNA, 21 nt, Artificial Sequence
  siRNA sense strand against APCS
gaaaaugaaaugacugucuaa

SEQ ID NO: 548 - RNA, 21 nt, Artificial Sequence
  siRNA sense strand against APCS
aaaaugaaaugacugucuaag

SEQ ID NO: 549 - RNA, 21 nt, Artificial Sequence
  siRNA sense strand against APCS
aaaugaaaugacugucuaaga

SEQ ID NO: 550 - RNA, 21 nt, Artificial Sequence
  siRNA sense strand against APCS
aaugaaaugacugucuaagag

SEQ ID NO: 551 - RNA, 21 nt, Artificial Sequence
  siRNA sense strand against APCS
augaaaugacugucuaagaga

SEQ ID NO: 552 - RNA, 21 nt, Artificial Sequence
  siRNA sense strand against APCS
ugaaaugacugucuaagagau

SEQ ID NO: 553 - RNA, 21 nt, Artificial Sequence
  siRNA sense strand against APCS
gaaaugacugucuaagagauc

SEQ ID NO: 554 - RNA, 21 nt, Artificial Sequence
  siRNA sense strand against APCS
aaaugacugucuaagagaucu

SEQ ID NO: 555 - RNA, 21 nt, Artificial Sequence
  siRNA sense strand against APCS
augacugucuaagagaucugg

SEQ ID NO: 556 - RNA, 21 nt, Artificial Sequence
  siRNA sense strand against APCS
ugacugucuaagagaucuggu

SEQ ID NO: 557 - RNA, 21 nt, Artificial Sequence
  siRNA sense strand against APCS
gacugucuaagagaucugguc

SEQ ID NO: 558 - RNA, 21 nt, Artificial Sequence
  siRNA sense strand against APCS
acugucuaagagaucugguca

SEQ ID NO: 559 - RNA, 21 nt, Artificial Sequence
  siRNA sense strand against APCS
cugucuaagagaucuggucaa

SEQ ID NO: 560 - RNA, 21 nt, Artificial Sequence
  siRNA sense strand against APCS
ugucuaagagaucuggucaaa

SEQ ID NO: 561 - RNA, 21 nt, Artificial Sequence
  siRNA sense strand against APCS
gucuaagagaucuggucaaag

SEQ ID NO: 562 - RNA, 21 nt, Artificial Sequence
  siRNA sense strand against APCS
ucuaagagaucuggucaaagc

SEQ ID NO: 563 - RNA, 21 nt, Artificial Sequence
  siRNA sense strand against APCS
cuaagagaucuggucaaagca

SEQ ID NO: 564 - RNA, 21 nt, Artificial Sequence
  siRNA sense strand against APCS
uaagagaucuggucaaagcaa

SEQ ID NO: 565 - RNA, 21 nt, Artificial Sequence
  siRNA sense strand against APCS
aagagaucuggucaaagcaac

SEQ ID NO: 566 - RNA, 21 nt, Artificial Sequence
  siRNA sense strand against APCS
agagaucuggucaaagcaacu

SEQ ID NO: 567 - RNA, 21 nt, Artificial Sequence
  siRNA sense strand against APCS
gagaucuggucaaagcaacug

SEQ ID NO: 568 - RNA, 21 nt, Artificial Sequence
  siRNA sense strand against APCS
agaucuggucaaagcaacugg

SEQ ID NO: 569 - RNA, 21 nt, Artificial Sequence
  siRNA sense strand against APCS
gaucuggucaaagcaacugga

SEQ ID NO: 570 - RNA, 21 nt, Artificial Sequence
  siRNA sense strand against APCS
aucuggucaaagcaacuggau

SEQ ID NO: 571 - RNA, 21 nt, Artificial Sequence
  siRNA sense strand against APCS
ucuggucaaagcaacuggaua

SEQ ID NO: 572 - RNA, 21 nt, Artificial Sequence
  siRNA sense strand against APCS
cuggucaaagcaacuggauac

SEQ ID NO: 573 - RNA, 21 nt, Artificial Sequence
  siRNA sense strand against APCS
uggucaaagcaacuggauacu

SEQ ID NO: 574 - RNA, 21 nt, Artificial Sequence
  siRNA sense strand against APCS
ggucaaagcaacuggauacua

SEQ ID NO: 575 - RNA, 21 nt, Artificial Sequence
  siRNA sense strand against APCS
gucaaagcaacuggauacuag

SEQ ID NO: 576 - RNA, 21 nt, Artificial Sequence
  siRNA sense strand against APCS
ucaaagcaacuggauacuaga

SEQ ID NO: 577 - RNA, 21 nt, Artificial Sequence
  siRNA sense strand against APCS
caaagcaacuggauacuagau

SEQ ID NO: 578 - RNA, 21 nt, Artificial Sequence
  siRNA sense strand against APCS
aaagcaacuggauacuagauc

SEQ ID NO: 579 - RNA, 21 nt, Artificial Sequence
  siRNA sense strand against APCS
aagcaacuggauacuagaucu

SEQ ID NO: 580 - RNA, 21 nt, Artificial Sequence
  siRNA sense strand against APCS
agcaacuggauacuagaucuu

SEQ ID NO: 581 - RNA, 21 nt, Artificial Sequence
  siRNA sense strand against APCS
gcaacuggauacuagaucuua

SEQ ID NO: 582 - RNA, 21 nt, Artificial Sequence
  siRNA sense strand against APCS
caacuggauacuagaucuuac

SEQ ID NO: 583 - RNA, 21 nt, Artificial Sequence
  siRNA sense strand against APCS
aacuggauacuagaucuuaca

SEQ ID NO: 584 - RNA, 21 nt, Artificial Sequence
  siRNA sense strand against APCS
acuggauacuagaucuuacau

SEQ ID NO: 585 - RNA, 21 nt, Artificial Sequence
  siRNA sense strand against APCS
cuggauacuagaucuuacauc

SEQ ID NO: 586 - RNA, 21 nt, Artificial Sequence
  siRNA sense strand against APCS
uggauacuagaucuuacaucu

SEQ ID NO: 587 - RNA, 21 nt, Artificial Sequence
  siRNA sense strand against APCS
ggauacuagaucuuacaucug

SEQ ID NO: 588 - RNA, 21 nt, Artificial Sequence
  siRNA sense strand against APCS
gauacuagaucuuacaucugc

SEQ ID NO: 589 - RNA, 21 nt, Artificial Sequence
  siRNA sense strand against APCS
auacuagaucuuacaucugca

SEQ ID NO: 590 - RNA, 21 nt, Artificial Sequence
  siRNA sense strand against APCS
acuagaucuuacaucugcagc

SEQ ID NO: 591 - RNA, 21 nt, Artificial Sequence
  siRNA sense strand against APCS
cuagaucuuacaucugcagcu

SEQ ID NO: 592 - RNA, 21 nt, Artificial Sequence
  siRNA sense strand against APCS
agaucuuacaucugcagcucu

SEQ ID NO: 593 - RNA, 21 nt, Artificial Sequence
  siRNA sense strand against APCS
gaucuuacaucugcagcucuu

SEQ ID NO: 594 - RNA, 21 nt, Artificial Sequence
  siRNA sense strand against APCS
aucuuacaucugcagcucuuu

SEQ ID NO: 595 - RNA, 21 nt, Artificial Sequence
  siRNA sense strand against APCS
ucuuacaucugcagcucuuuc

SEQ ID NO: 596 - RNA, 21 nt, Artificial Sequence
  siRNA sense strand against APCS
cuuacaucugcagcucuuucu

SEQ ID NO: 597 - RNA, 21 nt, Artificial Sequence
  siRNA sense strand against APCS
uuacaucugcagcucuuucuu

SEQ ID NO: 598 - RNA, 21 nt, Artificial Sequence
  siRNA sense strand against APCS
uacaucugcagcucuuucuuc

SEQ ID NO: 599 - RNA, 21 nt, Artificial Sequence
  siRNA sense strand against APCS
acaucugcagcucuuucuucu

SEQ ID NO: 600 - RNA, 21 nt, Artificial Sequence
  siRNA sense strand against APCS
caucugcagcucuuucuucuu

SEQ ID NO: 601 - RNA, 21 nt, Artificial Sequence
  siRNA sense strand against APCS
aucugcagcucuuucuucuuu

SEQ ID NO: 602 - RNA, 21 nt, Artificial Sequence
  siRNA sense strand against APCS
ucugcagcucuuucuucuuug

SEQ ID NO: 603 - RNA, 21 nt, Artificial Sequence
  siRNA sense strand against APCS
cugcagcucuuucuucuuuga

SEQ ID NO: 604 - RNA, 21 nt, Artificial Sequence
  siRNA sense strand against APCS
ugcagcucuuucuucuuugaa

SEQ ID NO: 605 - RNA, 21 nt, Artificial Sequence
  siRNA sense strand against APCS
gcagcucuuucuucuuugaau

SEQ ID NO: 606 - RNA, 21 nt, Artificial Sequence
  siRNA sense strand against APCS
cagcucuuucuucuuugaauu

SEQ ID NO: 607 - RNA, 21 nt, Artificial Sequence
  siRNA sense strand against APCS
agcucuuucuucuuugaauuu

SEQ ID NO: 608 - RNA, 21 nt, Artificial Sequence
  siRNA sense strand against APCS
gcucuuucuucuuugaauuuc

SEQ ID NO: 609 - RNA, 21 nt, Artificial Sequence
  siRNA sense strand against APCS
cucuuucuucuuugaauuucc

SEQ ID NO: 610 - RNA, 21 nt, Artificial Sequence
  siRNA sense strand against APCS
ucuuucuucuuugaauuuccu

SEQ ID NO: 611 - RNA, 21 nt, Artificial Sequence
  siRNA sense strand against APCS
cuuucuucuuugaauuuccua

SEQ ID NO: 612 - RNA, 21 nt, Artificial Sequence
  siRNA sense strand against APCS
uuucuucuuugaauuuccuau

SEQ ID NO: 613 - RNA, 21 nt, Artificial Sequence
  siRNA sense strand against APCS
uucuucuuugaauuuccuauc

SEQ ID NO: 614 - RNA, 21 nt, Artificial Sequence
  siRNA sense strand against APCS
ucuucuuugaauuuccuaucu

SEQ ID NO: 615 - RNA, 21 nt, Artificial Sequence
  siRNA sense strand against APCS
uucuuugaauuuccuaucugu

SEQ ID NO: 616 - RNA, 21 nt, Artificial Sequence
  siRNA sense strand against APCS
ucuuugaauuuccuaucugua

SEQ ID NO: 617 - RNA, 21 nt, Artificial Sequence
  siRNA sense strand against APCS
cuuugaauuuccuaucuguau

SEQ ID NO: 618 - RNA, 21 nt, Artificial Sequence
  siRNA sense strand against APCS
uuugaauuuccuaucuguaug

SEQ ID NO: 619 - RNA, 21 nt, Artificial Sequence
  siRNA sense strand against APCS
uugaauuuccuaucuguaugu

SEQ ID NO: 620 - RNA, 21 nt, Artificial Sequence
  siRNA sense strand against APCS
ugaauuuccuaucuguauguc

SEQ ID NO: 621 - RNA, 21 nt, Artificial Sequence
  siRNA sense strand against APCS
gaauuuccuaucuguaugucu

SEQ ID NO: 622 - RNA, 21 nt, Artificial Sequence
  siRNA sense strand against APCS
auuuccuaucuguaugucugc

SEQ ID NO: 623 - RNA, 21 nt, Artificial Sequence
  siRNA sense strand against APCS
uuuccuaucuguaugucugcc

SEQ ID NO: 624 - RNA, 21 nt, Artificial Sequence
  siRNA sense strand against APCS
uuccuaucuguaugucugccu

SEQ ID NO: 625 - RNA, 21 nt, Artificial Sequence
  siRNA sense strand against APCS
uccuaucuguaugucugccua

SEQ ID NO: 626 - RNA, 21 nt, Artificial Sequence
  siRNA sense strand against APCS
ccuaucuguaugucugccuaa

SEQ ID NO: 627 - RNA, 21 nt, Artificial Sequence
  siRNA sense strand against APCS
cuaucuguaugucugccuaau

SEQ ID NO: 628 - RNA, 21 nt, Artificial Sequence
  siRNA sense strand against APCS
uaucuguaugucugccuaauu

SEQ ID NO: 629 - RNA, 21 nt, Artificial Sequence
  siRNA sense strand against APCS
aucuguaugucugccuaauua

SEQ ID NO: 630 - RNA, 21 nt, Artificial Sequence
  siRNA sense strand against APCS
ucuguaugucugccuaauuaa

SEQ ID NO: 631 - RNA, 21 nt, Artificial Sequence
  siRNA sense strand against APCS
cuguaugucugccuaauuaaa

SEQ ID NO: 632 - RNA, 21 nt, Artificial Sequence
  siRNA sense strand against APCS
uguaugucugccuaauuaaaa

SEQ ID NO: 633 - RNA, 21 nt, Artificial Sequence
  siRNA sense strand against APCS
guaugucugccuaauuaaaaa

SEQ ID NO: 634 - RNA, 21 nt, Artificial Sequence
  siRNA sense strand against APCS
uaugucugccuaauuaaaaaa

SEQ ID NO: 635 - RNA, 21 nt, Artificial Sequence
  siRNA sense strand against APCS
augucugccuaauuaaaaaaa

SEQ ID NO: 636 - RNA, 21 nt, Artificial Sequence
  siRNA sense strand against APCS
ugucugccuaauuaaaaaaau

SEQ ID NO: 637 - RNA, 21 nt, Artificial Sequence
  siRNA sense strand against APCS
gucugccuaauuaaaaaaaua

SEQ ID NO: 638 - RNA, 21 nt, Artificial Sequence
  siRNA sense strand against APCS
ucugccuaauuaaaaaaauau

SEQ ID NO: 639 - RNA, 21 nt, Artificial Sequence
  siRNA sense strand against APCS
cugccuaauuaaaaaaauaua

SEQ ID NO: 640 - RNA, 21 nt, Artificial Sequence
  siRNA sense strand against APCS
ugccuaauuaaaaaaauauau

SEQ ID NO: 641 - RNA, 21 nt, Artificial Sequence
  siRNA sense strand against APCS
gccuaauuaaaaaaauauaua

SEQ ID NO: 642 - RNA, 21 nt, Artificial Sequence
  siRNA sense strand against APCS
ccuaauuaaaaaaauauauau

SEQ ID NO: 643 - RNA, 21 nt, Artificial Sequence
  siRNA sense strand against APCS
cuaauuaaaaaaauauauauu

SEQ ID NO: 644 - RNA, 21 nt, Artificial Sequence
  siRNA sense strand against APCS
uaaaaaaauauauauuguauu

SEQ ID NO: 645 - RNA, 21 nt, Artificial Sequence
  siRNA antisense strand against APCS
uagcgucugauauucaugccc

SEQ ID NO: 646 - RNA, 21 nt, Artificial Sequence
  siRNA antisense strand against APCS
cuagcgucugauauucaugcc

SEQ ID NO: 647 - RNA, 21 nt, Artificial Sequence
  siRNA antisense strand against APCS
ucccccuagcgucugauauuc

SEQ ID NO: 648 - RNA, 21 nt, Artificial Sequence
  siRNA antisense strand against APCS
acaguggcugucccccuagcg

SEQ ID NO: 649 - RNA, 21 nt, Artificial Sequence
  siRNA antisense strand against APCS
acacaguggcugucccccuag

SEQ ID NO: 650 - RNA, 21 nt, Artificial Sequence
  siRNA antisense strand against APCS
caacacaguggcugucccccu

SEQ ID NO: 651 - RNA, 21 nt, Artificial Sequence
  siRNA antisense strand against APCS
acaacacaguggcuguccccc

SEQ ID NO: 652 - RNA, 21 nt, Artificial Sequence
  siRNA antisense strand against APCS
gacaacacaguggcugucccc

SEQ ID NO: 653 - RNA, 21 nt, Artificial Sequence
  siRNA antisense strand against APCS
agacaacacaguggcuguccc

SEQ ID NO: 654 - RNA, 21 nt, Artificial Sequence
  siRNA antisense strand against APCS
uagcagacaacacaguggcug

SEQ ID NO: 655 - RNA, 21 nt, Artificial Sequence
  siRNA antisense strand against APCS
guagcagacaacacaguggcu

SEQ ID NO: 656 - RNA, 21 nt, Artificial Sequence
  siRNA antisense strand against APCS
gguagcagacaacacaguggc

SEQ ID NO: 657 - RNA, 21 nt, Artificial Sequence
  siRNA antisense strand against APCS
aggguagcagacaacacagug

SEQ ID NO: 658 - RNA, 21 nt, Artificial Sequence
  siRNA antisense strand against APCS
gaggguagcagacaacacagu

SEQ ID NO: 659 - RNA, 21 nt, Artificial Sequence
  siRNA antisense strand against APCS
ugaggguagcagacaacacag

SEQ ID NO: 660 - RNA, 21 nt, Artificial Sequence
  siRNA antisense strand against APCS
augaggguagcagacaacaca

SEQ ID NO: 661 - RNA, 21 nt, Artificial Sequence
  siRNA antisense strand against APCS
gaugaggguagcagacaacac

SEQ ID NO: 662 - RNA, 21 nt, Artificial Sequence
  siRNA antisense strand against APCS
caggaugaggguagcagacaa

SEQ ID NO: 663 - RNA, 21 nt, Artificial Sequence
  siRNA antisense strand against APCS
accaggaugaggguagcagac

SEQ ID NO: 664 - RNA, 21 nt, Artificial Sequence
  siRNA antisense strand against APCS
ugaccaggaugaggguagcag

SEQ ID NO: 665 - RNA, 21 nt, Artificial Sequence
  siRNA antisense strand against APCS
gugaccaggaugaggguagca

SEQ ID NO: 666 - RNA, 21 nt, Artificial Sequence
  siRNA antisense strand against APCS
agugaccaggaugaggguagc

SEQ ID NO: 667 - RNA, 21 nt, Artificial Sequence
  siRNA antisense strand against APCS
cagugaccaggaugaggguag

SEQ ID NO: 668 - RNA, 21 nt, Artificial Sequence
  siRNA antisense strand against APCS
gcagugaccaggaugagggua

SEQ ID NO: 669 - RNA, 21 nt, Artificial Sequence
  siRNA antisense strand against APCS
agcagugaccaggaugagggu

SEQ ID NO: 670 - RNA, 21 nt, Artificial Sequence
  siRNA antisense strand against APCS
aagcagugaccaggaugaggg

SEQ ID NO: 671 - RNA, 21 nt, Artificial Sequence
  siRNA antisense strand against APCS
agaagcagugaccaggaugag

SEQ ID NO: 672 - RNA, 21 nt, Artificial Sequence
  siRNA antisense strand against APCS
cagaagcagugaccaggauga

SEQ ID NO: 673 - RNA, 21 nt, Artificial Sequence
  siRNA antisense strand against APCS
gcagaagcagugaccaggaug

SEQ ID NO: 674 - RNA, 21 nt, Artificial Sequence
  siRNA antisense strand against APCS
agcagaagcagugaccaggau

SEQ ID NO: 675 - RNA, 21 nt, Artificial Sequence
  siRNA antisense strand against APCS
uagcagaagcagugaccagga

SEQ ID NO: 676 - RNA, 21 nt, Artificial Sequence
  siRNA antisense strand against APCS
auagcagaagcagugaccagg

SEQ ID NO: 677 - RNA, 21 nt, Artificial Sequence
  siRNA antisense strand against APCS
uauagcagaagcagugaccag

SEQ ID NO: 678 - RNA, 21 nt, Artificial Sequence
  siRNA antisense strand against APCS
uuauagcagaagcagugacca

SEQ ID NO: 679 - RNA, 21 nt, Artificial Sequence
  siRNA antisense strand against APCS
uguuauagcagaagcagugac

SEQ ID NO: 680 - RNA, 21 nt, Artificial Sequence
  siRNA antisense strand against APCS
cuguuauagcagaagcaguga

SEQ ID NO: 681 - RNA, 21 nt, Artificial Sequence
  siRNA antisense strand against APCS
gcuguuauagcagaagcagug

SEQ ID NO: 682 - RNA, 21 nt, Artificial Sequence
  siRNA antisense strand against APCS
gggcuguuauagcagaagcag

SEQ ID NO: 683 - RNA, 21 nt, Artificial Sequence
  siRNA antisense strand against APCS
agggcuguuauagcagaagca

SEQ ID NO: 684 - RNA, 21 nt, Artificial Sequence
  siRNA antisense strand against APCS
uagggcuguuauagcagaagc

SEQ ID NO: 685 - RNA, 21 nt, Artificial Sequence
  siRNA antisense strand against APCS
cuagggcuguuauagcagaag

SEQ ID NO: 686 - RNA, 21 nt, Artificial Sequence
  siRNA antisense strand against APCS
ccuagggcuguuauagcagaa

SEQ ID NO: 687 - RNA, 21 nt, Artificial Sequence
  siRNA antisense strand against APCS
gccuagggcuguuauagcaga

SEQ ID NO: 688 - RNA, 21 nt, Artificial Sequence
  siRNA antisense strand against APCS
ggccuagggcuguuauagcag

SEQ ID NO: 689 - RNA, 21 nt, Artificial Sequence
  siRNA antisense strand against APCS
uggccuagggcuguuauagca

SEQ ID NO: 690 - RNA, 21 nt, Artificial Sequence
  siRNA antisense strand against APCS
cuggccuagggcuguuauagc

SEQ ID NO: 691 - RNA, 21 nt, Artificial Sequence
  siRNA antisense strand against APCS
ccuggccuagggcuguuauag

SEQ ID NO: 692 - RNA, 21 nt, Artificial Sequence
  siRNA antisense strand against APCS
uccuggccuagggcuguuaua

SEQ ID NO: 693 - RNA, 21 nt, Artificial Sequence
  siRNA antisense strand against APCS
auuccuggccuagggcuguua

SEQ ID NO: 694 - RNA, 21 nt, Artificial Sequence
  siRNA antisense strand against APCS
uauuccuggccuagggcuguu

SEQ ID NO: 695 - RNA, 21 nt, Artificial Sequence
  siRNA antisense strand against APCS
auauuccuggccuagggcugu

SEQ ID NO: 696 - RNA, 21 nt, Artificial Sequence
  siRNA antisense strand against APCS
cauauuccuggccuagggcug

SEQ ID NO: 697 - RNA, 21 nt, Artificial Sequence
  siRNA antisense strand against APCS
ucauauuccuggccuagggcu

SEQ ID NO: 698 - RNA, 21 nt, Artificial Sequence
  siRNA antisense strand against APCS
uucauauuccuggccuagggc

SEQ ID NO: 699 - RNA, 21 nt, Artificial Sequence
  siRNA antisense strand against APCS
guucauauuccuggccuaggg

SEQ ID NO: 700 - RNA, 21 nt, Artificial Sequence
  siRNA antisense strand against APCS
uguucauauuccuggccuagg

SEQ ID NO: 701 - RNA, 21 nt, Artificial Sequence
  siRNA antisense strand against APCS
uuguucauauuccuggccuag

SEQ ID NO: 702 - RNA, 21 nt, Artificial Sequence
  siRNA antisense strand against APCS
cuuguucauauuccuggccua

SEQ ID NO: 703 - RNA, 21 nt, Artificial Sequence
  siRNA antisense strand against APCS
gcuuguucauauuccuggccu

SEQ ID NO: 704 - RNA, 21 nt, Artificial Sequence
  siRNA antisense strand against APCS
ggcuuguucauauuccuggcc

SEQ ID NO: 705 - RNA, 21 nt, Artificial Sequence
  siRNA antisense strand against APCS
cggcuuguucauauuccuggc

SEQ ID NO: 706 - RNA, 21 nt, Artificial Sequence
  siRNA antisense strand against APCS
gcggcuuguucauauuccugg

SEQ ID NO: 707 - RNA, 21 nt, Artificial Sequence
  siRNA antisense strand against APCS
agcggcuuguucauauuccug

SEQ ID NO: 708 - RNA, 21 nt, Artificial Sequence
  siRNA antisense strand against APCS
cagcggcuuguucauauuccu

SEQ ID NO: 709 - RNA, 21 nt, Artificial Sequence
  siRNA antisense strand against APCS
gcagcggcuuguucauauucc

SEQ ID NO: 710 - RNA, 21 nt, Artificial Sequence
  siRNA antisense strand against APCS
agcagcggcuuguucauauuc

SEQ ID NO: 711 - RNA, 21 nt, Artificial Sequence
  siRNA antisense strand against APCS
aagcagcggcuuguucauauu

SEQ ID NO: 712 - RNA, 21 nt, Artificial Sequence
  siRNA antisense strand against APCS
aaagcagcggcuuguucauau

SEQ ID NO: 713 - RNA, 21 nt, Artificial Sequence
  siRNA antisense strand against APCS
caaagcagcggcuuguucaua

SEQ ID NO: 714 - RNA, 21 nt, Artificial Sequence
  siRNA antisense strand against APCS
ccaaagcagcggcuuguucau

SEQ ID NO: 715 - RNA, 21 nt, Artificial Sequence
  siRNA antisense strand against APCS
uccaaagcagcggcuuguuca

SEQ ID NO: 716 - RNA, 21 nt, Artificial Sequence
  siRNA antisense strand against APCS
auccaaagcagcggcuuguuc

SEQ ID NO: 717 - RNA, 21 nt, Artificial Sequence
  siRNA antisense strand against APCS
gauccaaagcagcggcuuguu

SEQ ID NO: 718 - RNA, 21 nt, Artificial Sequence
  siRNA antisense strand against APCS
agauccaaagcagcggcuugu

SEQ ID NO: 719 - RNA, 21 nt, Artificial Sequence
  siRNA antisense strand against APCS
gagauccaaagcagcggcuug

SEQ ID NO: 720 - RNA, 21 nt, Artificial Sequence
  siRNA antisense strand against APCS
agagauccaaagcagcggcuu

SEQ ID NO: 721 - RNA, 21 nt, Artificial Sequence
  siRNA antisense strand against APCS
cagagauccaaagcagcggcu

SEQ ID NO: 722 - RNA, 21 nt, Artificial Sequence
  siRNA antisense strand against APCS
acagagauccaaagcagcggc

SEQ ID NO: 723 - RNA, 21 nt, Artificial Sequence
  siRNA antisense strand against APCS
gacagagauccaaagcagcgg

SEQ ID NO: 724 - RNA, 21 nt, Artificial Sequence
  siRNA antisense strand against APCS
ggacagagauccaaagcagcg

SEQ ID NO: 725 - RNA, 21 nt, Artificial Sequence
  siRNA antisense strand against APCS
aggacagagauccaaagcagc

SEQ ID NO: 726 - RNA, 21 nt, Artificial Sequence
  siRNA antisense strand against APCS
gaggacagagauccaaagcag

SEQ ID NO: 727 - RNA, 21 nt, Artificial Sequence
  siRNA antisense strand against APCS
ugaggacagagauccaaagca

SEQ ID NO: 728 - RNA, 21 nt, Artificial Sequence
  siRNA antisense strand against APCS
gugaggacagagauccaaagc

SEQ ID NO: 729 - RNA, 21 nt, Artificial Sequence
  siRNA antisense strand against APCS
cuggugaggacagagauccaa

SEQ ID NO: 730 - RNA, 21 nt, Artificial Sequence
  siRNA antisense strand against APCS
gcuggugaggacagagaucca

SEQ ID NO: 731 - RNA, 21 nt, Artificial Sequence
  siRNA antisense strand against APCS
gaggcuggugaggacagagau

SEQ ID NO: 732 - RNA, 21 nt, Artificial Sequence
  siRNA antisense strand against APCS
aggaggcuggugaggacagag

SEQ ID NO: 733 - RNA, 21 nt, Artificial Sequence
  siRNA antisense strand against APCS
caggaggcuggugaggacaga

SEQ ID NO: 734 - RNA, 21 nt, Artificial Sequence
  siRNA antisense strand against APCS
ccaggaggcuggugaggacag

SEQ ID NO: 735 - RNA, 21 nt, Artificial Sequence
  siRNA antisense strand against APCS
uccaggaggcuggugaggaca

SEQ ID NO: 736 - RNA, 21 nt, Artificial Sequence
  siRNA antisense strand against APCS
cuuccaggaggcuggugagga

SEQ ID NO: 737 - RNA, 21 nt, Artificial Sequence
  siRNA antisense strand against APCS
gcuuccaggaggcuggugagg

SEQ ID NO: 738 - RNA, 21 nt, Artificial Sequence
  siRNA antisense strand against APCS
aggcuuccaggaggcugguga

SEQ ID NO: 739 - RNA, 21 nt, Artificial Sequence
  siRNA antisense strand against APCS
aaggcuuccaggaggcuggug

SEQ ID NO: 740 - RNA, 21 nt, Artificial Sequence
  siRNA antisense strand against APCS
aaaggcuuccaggaggcuggu

SEQ ID NO: 741 - RNA, 21 nt, Artificial Sequence
  siRNA antisense strand against APCS
caaaggcuuccaggaggcugg

SEQ ID NO: 742 - RNA, 21 nt, Artificial Sequence
  siRNA antisense strand against APCS
gcaaaggcuuccaggaggcug

SEQ ID NO: 743 - RNA, 21 nt, Artificial Sequence
  siRNA antisense strand against APCS
agcaaaggcuuccaggaggcu

SEQ ID NO: 744 - RNA, 21 nt, Artificial Sequence
  siRNA antisense strand against APCS
gagcaaaggcuuccaggaggc

SEQ ID NO: 745 - RNA, 21 nt, Artificial Sequence
  siRNA antisense strand against APCS
ugagcaaaggcuuccaggagg

SEQ ID NO: 746 - RNA, 21 nt, Artificial Sequence
  siRNA antisense strand against APCS
gugagcaaaggcuuccaggag

SEQ ID NO: 747 - RNA, 21 nt, Artificial Sequence
  siRNA antisense strand against APCS
ugugagcaaaggcuuccagga

SEQ ID NO: 748 - RNA, 21 nt, Artificial Sequence
  siRNA antisense strand against APCS
ugugugagcaaaggcuuccag

SEQ ID NO: 749 - RNA, 21 nt, Artificial Sequence
  siRNA antisense strand against APCS
cugugugagcaaaggcuucca

SEQ ID NO: 750 - RNA, 21 nt, Artificial Sequence
  siRNA antisense strand against APCS
ucugugugagcaaaggcuucc

SEQ ID NO: 751 - RNA, 21 nt, Artificial Sequence
  siRNA antisense strand against APCS
gucugugugagcaaaggcuuc

SEQ ID NO: 752 - RNA, 21 nt, Artificial Sequence
  siRNA antisense strand against APCS
ggucugugugagcaaaggcuu

SEQ ID NO: 753 - RNA, 21 nt, Artificial Sequence
  siRNA antisense strand against APCS
aggucugugugagcaaaggcu

SEQ ID NO: 754 - RNA, 21 nt, Artificial Sequence
  siRNA antisense strand against APCS
gaggucugugugagcaaaggc

SEQ ID NO: 755 - RNA, 21 nt, Artificial Sequence
  siRNA antisense strand against APCS
ugaggucugugugagcaaagg

SEQ ID NO: 756 - RNA, 21 nt, Artificial Sequence
  siRNA antisense strand against APCS
acugaggucugugugagcaaa

SEQ ID NO: 757 - RNA, 21 nt, Artificial Sequence
  siRNA antisense strand against APCS
ccacugaggucugugugagca

SEQ ID NO: 758 - RNA, 21 nt, Artificial Sequence
  siRNA antisense strand against APCS
ucccacugaggucugugugag

SEQ ID NO: 759 - RNA, 21 nt, Artificial Sequence
  siRNA antisense strand against APCS
uucccacugaggucuguguga

SEQ ID NO: 760 - RNA, 21 nt, Artificial Sequence
  siRNA antisense strand against APCS
cuucccacugaggucugugug

SEQ ID NO: 761 - RNA, 21 nt, Artificial Sequence
  siRNA antisense strand against APCS
caccuucccacugaggucugu

SEQ ID NO: 762 - RNA, 21 nt, Artificial Sequence
  siRNA antisense strand against APCS
acaccuucccacugaggucug

SEQ ID NO: 763 - RNA, 21 nt, Artificial Sequence
  siRNA antisense strand against APCS
aacaccuucccacugaggucu

SEQ ID NO: 764 - RNA, 21 nt, Artificial Sequence
  siRNA antisense strand against APCS
aaacaccuucccacugagguc

SEQ ID NO: 765 - RNA, 21 nt, Artificial Sequence
  siRNA antisense strand against APCS
caaacaccuucccacugaggu

SEQ ID NO: 766 - RNA, 21 nt, Artificial Sequence
  siRNA antisense strand against APCS
acaaacaccuucccacugagg

SEQ ID NO: 767 - RNA, 21 nt, Artificial Sequence
  siRNA antisense strand against APCS
uacaaacaccuucccacugag

SEQ ID NO: 768 - RNA, 21 nt, Artificial Sequence
  siRNA antisense strand against APCS
auacaaacaccuucccacuga

SEQ ID NO: 769 - RNA, 21 nt, Artificial Sequence
  siRNA antisense strand against APCS
aauacaaacaccuucccacug

SEQ ID NO: 770 - RNA, 21 nt, Artificial Sequence
  siRNA antisense strand against APCS
aaauacaaacaccuucccacu

SEQ ID NO: 771 - RNA, 21 nt, Artificial Sequence
  siRNA antisense strand against APCS
gaaauacaaacaccuucccac

SEQ ID NO: 772 - RNA, 21 nt, Artificial Sequence
  siRNA antisense strand against APCS
ggaaauacaaacaccuuccca

SEQ ID NO: 773 - RNA, 21 nt, Artificial Sequence
  siRNA antisense strand against APCS
aggaaauacaaacaccuuccc

SEQ ID NO: 774 - RNA, 21 nt, Artificial Sequence
  siRNA antisense strand against APCS
uaggaaauacaaacaccuucc

SEQ ID NO: 775 - RNA, 21 nt, Artificial Sequence
  siRNA antisense strand against APCS
cuaggaaauacaaacaccuuc

SEQ ID NO: 776 - RNA, 21 nt, Artificial Sequence
  siRNA antisense strand against APCS
ucuaggaaauacaaacaccuu

SEQ ID NO: 777 - RNA, 21 nt, Artificial Sequence
  siRNA antisense strand against APCS
cucuaggaaauacaaacaccu

SEQ ID NO: 778 - RNA, 21 nt, Artificial Sequence
  siRNA antisense strand against APCS
ucucuaggaaauacaaacacc

SEQ ID NO: 779 - RNA, 21 nt, Artificial Sequence
  siRNA antisense strand against APCS
uucucuaggaaauacaaacac

SEQ ID NO: 780 - RNA, 21 nt, Artificial Sequence
  siRNA antisense strand against APCS
auucucuaggaaauacaaaca

SEQ ID NO: 781 - RNA, 21 nt, Artificial Sequence
  siRNA antisense strand against APCS
gauucucuaggaaauacaaac

SEQ ID NO: 782 - RNA, 21 nt, Artificial Sequence
  siRNA antisense strand against APCS
agauucucuaggaaauacaaa

SEQ ID NO: 783 - RNA, 21 nt, Artificial Sequence
  siRNA antisense strand against APCS
cagauucucuaggaaauacaa

SEQ ID NO: 784 - RNA, 21 nt, Artificial Sequence
  siRNA antisense strand against APCS
acagauucucuaggaaauaca

SEQ ID NO: 785 - RNA, 21 nt, Artificial Sequence
  siRNA antisense strand against APCS
aacagauucucuaggaaauac

SEQ ID NO: 786 - RNA, 21 nt, Artificial Sequence
  siRNA antisense strand against APCS
uaacagauucucuaggaaaua

SEQ ID NO: 787 - RNA, 21 nt, Artificial Sequence
  siRNA antisense strand against APCS
aguaacagauucucuaggaaa

SEQ ID NO: 788 - RNA, 21 nt, Artificial Sequence
  siRNA antisense strand against APCS
caguaacagauucucuaggaa

SEQ ID NO: 789 - RNA, 21 nt, Artificial Sequence
  siRNA antisense strand against APCS
ucaguaacagauucucuagga

SEQ ID NO: 790 - RNA, 21 nt, Artificial Sequence
  siRNA antisense strand against APCS
aucaguaacagauucucuagg

SEQ ID NO: 791 - RNA, 21 nt, Artificial Sequence
  siRNA antisense strand against APCS
gaucaguaacagauucucuag

SEQ ID NO: 792 - RNA, 21 nt, Artificial Sequence
  siRNA antisense strand against APCS
ugaucaguaacagauucucua

SEQ ID NO: 793 - RNA, 21 nt, Artificial Sequence
  siRNA antisense strand against APCS
augaucaguaacagauucucu

SEQ ID NO: 794 - RNA, 21 nt, Artificial Sequence
  siRNA antisense strand against APCS
caugaucaguaacagauucuc

SEQ ID NO: 795 - RNA, 21 nt, Artificial Sequence
  siRNA antisense strand against APCS
acaugaucaguaacagauucu

SEQ ID NO: 796 - RNA, 21 nt, Artificial Sequence
  siRNA antisense strand against APCS
uacaugaucaguaacagauuc

SEQ ID NO: 797 - RNA, 21 nt, Artificial Sequence
  siRNA antisense strand against APCS
uuacaugaucaguaacagauu

SEQ ID NO: 798 - RNA, 21 nt, Artificial Sequence
  siRNA antisense strand against APCS
uuuacaugaucaguaacagau

SEQ ID NO: 799 - RNA, 21 nt, Artificial Sequence
  siRNA antisense strand against APCS
guuuacaugaucaguaacaga

SEQ ID NO: 800 - RNA, 21 nt, Artificial Sequence
  siRNA antisense strand against APCS
aguuuacaugaucaguaacag

SEQ ID NO: 801 - RNA, 21 nt, Artificial Sequence
  siRNA antisense strand against APCS
ucaaguuuacaugaucaguaa

SEQ ID NO: 802 - RNA, 21 nt, Artificial Sequence
  siRNA antisense strand against APCS
aucaaguuuacaugaucagua

SEQ ID NO: 803 - RNA, 21 nt, Artificial Sequence
  siRNA antisense strand against APCS
gaucaaguuuacaugaucagu

SEQ ID NO: 804 - RNA, 21 nt, Artificial Sequence
  siRNA antisense strand against APCS
ugaucaaguuuacaugaucag

SEQ ID NO: 805 - RNA, 21 nt, Artificial Sequence
  siRNA antisense strand against APCS
ugugaucaaguuuacaugauc

SEQ ID NO: 806 - RNA, 21 nt, Artificial Sequence
  siRNA antisense strand against APCS
gugugaucaaguuuacaugau

SEQ ID NO: 807 - RNA, 21 nt, Artificial Sequence
  siRNA antisense strand against APCS
agcggugugaucaaguuuaca

SEQ ID NO: 808 - RNA, 21 nt, Artificial Sequence
  siRNA antisense strand against APCS
cagcggugugaucaaguuuac

SEQ ID NO: 809 - RNA, 21 nt, Artificial Sequence
  siRNA antisense strand against APCS
uccagcggugugaucaaguuu

SEQ ID NO: 810 - RNA, 21 nt, Artificial Sequence
  siRNA antisense strand against APCS
ucuccagcggugugaucaagu

SEQ ID NO: 811 - RNA, 21 nt, Artificial Sequence
  siRNA antisense strand against APCS
uucuccagcggugugaucaag

SEQ ID NO: 812 - RNA, 21 nt, Artificial Sequence
  siRNA antisense strand against APCS
cuucuccagcggugugaucaa

SEQ ID NO: 813 - RNA, 21 nt, Artificial Sequence
  siRNA antisense strand against APCS
aggcuucuccagcggugugau

SEQ ID NO: 814 - RNA, 21 nt, Artificial Sequence
  siRNA antisense strand against APCS
gaggcuucuccagcgguguga

SEQ ID NO: 815 - RNA, 21 nt, Artificial Sequence
  siRNA antisense strand against APCS
agaggcuucuccagcggugug

SEQ ID NO: 816 - RNA, 21 nt, Artificial Sequence
  siRNA antisense strand against APCS
uagaggcuucuccagcggugu

SEQ ID NO: 817 - RNA, 21 nt, Artificial Sequence
  siRNA antisense strand against APCS
guagaggcuucuccagcggug

SEQ ID NO: 818 - RNA, 21 nt, Artificial Sequence
  siRNA antisense strand against APCS
uguagaggcuucuccagcggu

SEQ ID NO: 819 - RNA, 21 nt, Artificial Sequence
  siRNA antisense strand against APCS
cuguagaggcuucuccagcgg

SEQ ID NO: 820 - RNA, 21 nt, Artificial Sequence
  siRNA antisense strand against APCS
ucuguagaggcuucuccagcg

SEQ ID NO: 821 - RNA, 21 nt, Artificial Sequence
  siRNA antisense strand against APCS
uucuguagaggcuucuccagc

SEQ ID NO: 822 - RNA, 21 nt, Artificial Sequence
  siRNA antisense strand against APCS
guucuguagaggcuucuccag

SEQ ID NO: 823 - RNA, 21 nt, Artificial Sequence
  siRNA antisense strand against APCS
aguucuguagaggcuucucca

SEQ ID NO: 824 - RNA, 21 nt, Artificial Sequence
  siRNA antisense strand against APCS
aaguucuguagaggcuucucc

SEQ ID NO: 825 - RNA, 21 nt, Artificial Sequence
  siRNA antisense strand against APCS
aaaguucuguagaggcuucuc

SEQ ID NO: 826 - RNA, 21 nt, Artificial Sequence
  siRNA antisense strand against APCS
uaaaguucuguagaggcuucu

SEQ ID NO: 827 - RNA, 21 nt, Artificial Sequence
  siRNA antisense strand against APCS
guaaaguucuguagaggcuuc

SEQ ID NO: 828 - RNA, 21 nt, Artificial Sequence
  siRNA antisense strand against APCS
gguaaaguucuguagaggcuu

SEQ ID NO: 829 - RNA, 21 nt, Artificial Sequence
  siRNA antisense strand against APCS
agguaaaguucuguagaggcu

SEQ ID NO: 830 - RNA, 21 nt, Artificial Sequence
  siRNA antisense strand against APCS
aagguaaaguucuguagaggc

SEQ ID NO: 831 - RNA, 21 nt, Artificial Sequence
  siRNA antisense strand against APCS
caagguaaaguucuguagagg

SEQ ID NO: 832 - RNA, 21 nt, Artificial Sequence
  siRNA antisense strand against APCS
acaagguaaaguucuguagag

SEQ ID NO: 833 - RNA, 21 nt, Artificial Sequence
  siRNA antisense strand against APCS
cacaagguaaaguucuguaga

SEQ ID NO: 834 - RNA, 21 nt, Artificial Sequence
  siRNA antisense strand against APCS
acacaagguaaaguucuguag

SEQ ID NO: 835 - RNA, 21 nt, Artificial Sequence
  siRNA antisense strand against APCS
aacacaagguaaaguucugua

SEQ ID NO: 836 - RNA, 21 nt, Artificial Sequence
  siRNA antisense strand against APCS
aaacacaagguaaaguucugu

SEQ ID NO: 837 - RNA, 21 nt, Artificial Sequence
  siRNA antisense strand against APCS
aaaacacaagguaaaguucug

SEQ ID NO: 838 - RNA, 21 nt, Artificial Sequence
  siRNA antisense strand against APCS
gaaaacacaagguaaaguucu

SEQ ID NO: 839 - RNA, 21 nt, Artificial Sequence
  siRNA antisense strand against APCS
ucgaaaacacaagguaaaguu

SEQ ID NO: 840 - RNA, 21 nt, Artificial Sequence
  siRNA antisense strand against APCS
aggcucgaaaacacaagguaa

SEQ ID NO: 841 - RNA, 21 nt, Artificial Sequence
  siRNA antisense strand against APCS
uaggcucgaaaacacaaggua

SEQ ID NO: 842 - RNA, 21 nt, Artificial Sequence
  siRNA antisense strand against APCS
auaggcucgaaaacacaaggu

SEQ ID NO: 843 - RNA, 21 nt, Artificial Sequence
  siRNA antisense strand against APCS
uauaggcucgaaaacacaagg

SEQ ID NO: 844 - RNA, 21 nt, Artificial Sequence
  siRNA antisense strand against APCS
acuauaggcucgaaaacacaa

SEQ ID NO: 845 - RNA, 21 nt, Artificial Sequence
  siRNA antisense strand against APCS
ucacuauaggcucgaaaacac

SEQ ID NO: 846 - RNA, 21 nt, Artificial Sequence
  siRNA antisense strand against APCS
aucacuauaggcucgaaaaca

SEQ ID NO: 847 - RNA, 21 nt, Artificial Sequence
  siRNA antisense strand against APCS
agagaucacuauaggcucgaa

SEQ ID NO: 848 - RNA, 21 nt, Artificial Sequence
  siRNA antisense strand against APCS
gagagaucacuauaggcucga

SEQ ID NO: 849 - RNA, 21 nt, Artificial Sequence
  siRNA antisense strand against APCS
agagagaucacuauaggcucg

SEQ ID NO: 850 - RNA, 21 nt, Artificial Sequence
  siRNA antisense strand against APCS
gagagagaucacuauaggcuc

SEQ ID NO: 851 - RNA, 21 nt, Artificial Sequence
  siRNA antisense strand against APCS
cgagagagaucacuauaggcu

SEQ ID NO: 852 - RNA, 21 nt, Artificial Sequence
  siRNA antisense strand against APCS
acgagagagaucacuauaggc

SEQ ID NO: 853 - RNA, 21 nt, Artificial Sequence
  siRNA antisense strand against APCS
cacgagagagaucacuauagg

SEQ ID NO: 854 - RNA, 21 nt, Artificial Sequence
  siRNA antisense strand against APCS
aggcacgagagagaucacuau

SEQ ID NO: 855 - RNA, 21 nt, Artificial Sequence
  siRNA antisense strand against APCS
uaggcacgagagagaucacua

SEQ ID NO: 856 - RNA, 21 nt, Artificial Sequence
  siRNA antisense strand against APCS
guaggcacgagagagaucacu

SEQ ID NO: 857 - RNA, 21 nt, Artificial Sequence
  siRNA antisense strand against APCS
uguaggcacgagagagaucac

SEQ ID NO: 858 - RNA, 21 nt, Artificial Sequence
  siRNA antisense strand against APCS
gaggcuguaggcacgagagag

SEQ ID NO: 859 - RNA, 21 nt, Artificial Sequence
  siRNA antisense strand against APCS
agaggcuguaggcacgagaga

SEQ ID NO: 860 - RNA, 21 nt, Artificial Sequence
  siRNA antisense strand against APCS
aagaggcuguaggcacgagag

SEQ ID NO: 861 - RNA, 21 nt, Artificial Sequence
  siRNA antisense strand against APCS
agaagaggcuguaggcacgag

SEQ ID NO: 862 - RNA, 21 nt, Artificial Sequence
  siRNA antisense strand against APCS
gagaagaggcuguaggcacga

SEQ ID NO: 863 - RNA, 21 nt, Artificial Sequence
  siRNA antisense strand against APCS
aggagaagaggcuguaggcac

SEQ ID NO: 864 - RNA, 21 nt, Artificial Sequence
  siRNA antisense strand against APCS
uaggagaagaggcuguaggca

SEQ ID NO: 865 - RNA, 21 nt, Artificial Sequence
  siRNA antisense strand against APCS
guaggagaagaggcuguaggc

SEQ ID NO: 866 - RNA, 21 nt, Artificial Sequence
  siRNA antisense strand against APCS
uguaggagaagaggcuguagg

SEQ ID NO: 867 - RNA, 21 nt, Artificial Sequence
  siRNA antisense strand against APCS
uuguaggagaagaggcuguag

SEQ ID NO: 868 - RNA, 21 nt, Artificial Sequence
  siRNA antisense strand against APCS
auuguaggagaagaggcugua

SEQ ID NO: 869 - RNA, 21 nt, Artificial Sequence
  siRNA antisense strand against APCS
uauuguaggagaagaggcugu

SEQ ID NO: 870 - RNA, 21 nt, Artificial Sequence
  siRNA antisense strand against APCS
guauuguaggagaagaggcug

SEQ ID NO: 871 - RNA, 21 nt, Artificial Sequence
  siRNA antisense strand against APCS
gguauuguaggagaagaggcu

SEQ ID NO: 872 - RNA, 21 nt, Artificial Sequence
  siRNA antisense strand against APCS
uggguauuguaggagaagagg

SEQ ID NO: 873 - RNA, 21 nt, Artificial Sequence
  siRNA antisense strand against APCS
ccuuggguauuguaggagaag

SEQ ID NO: 874 - RNA, 21 nt, Artificial Sequence
  siRNA antisense strand against APCS
gccuuggguauuguaggagaa

SEQ ID NO: 875 - RNA, 21 nt, Artificial Sequence
  siRNA antisense strand against APCS
ugccuuggguauuguaggaga

SEQ ID NO: 876 - RNA, 21 nt, Artificial Sequence
  siRNA antisense strand against APCS
cugccuuggguauuguaggag

SEQ ID NO: 877 - RNA, 21 nt, Artificial Sequence
  siRNA antisense strand against APCS
ccugccuuggguauuguagga

SEQ ID NO: 878 - RNA, 21 nt, Artificial Sequence
  siRNA antisense strand against APCS
aucccugccuuggguauugua

SEQ ID NO: 879 - RNA, 21 nt, Artificial Sequence
  siRNA antisense strand against APCS
uuaucccugccuuggguauug

SEQ ID NO: 880 - RNA, 21 nt, Artificial Sequence
  siRNA antisense strand against APCS
auuaucccugccuuggguauu

SEQ ID NO: 881 - RNA, 21 nt, Artificial Sequence
  siRNA antisense strand against APCS
cucauuaucccugccuugggu

SEQ ID NO: 882 - RNA, 21 nt, Artificial Sequence
  siRNA antisense strand against APCS
agcucauuaucccugccuugg

SEQ ID NO: 883 - RNA, 21 nt, Artificial Sequence
  siRNA antisense strand against APCS
uagcucauuaucccugccuug

SEQ ID NO: 884 - RNA, 21 nt, Artificial Sequence
  siRNA antisense strand against APCS
aguagcucauuaucccugccu

SEQ ID NO: 885 - RNA, 21 nt, Artificial Sequence
  siRNA antisense strand against APCS
uaguagcucauuaucccugcc

SEQ ID NO: 886 - RNA, 21 nt, Artificial Sequence
  siRNA antisense strand against APCS
cuaguagcucauuaucccugc

SEQ ID NO: 887 - RNA, 21 nt, Artificial Sequence
  siRNA antisense strand against APCS
acuaguagcucauuaucccug

SEQ ID NO: 888 - RNA, 21 nt, Artificial Sequence
  siRNA antisense strand against APCS
aacuaguagcucauuaucccu

SEQ ID NO: 889 - RNA, 21 nt, Artificial Sequence
  siRNA antisense strand against APCS
aaacuaguagcucauuauccc

SEQ ID NO: 890 - RNA, 21 nt, Artificial Sequence
  siRNA antisense strand against APCS
uaaacuaguagcucauuaucc

SEQ ID NO: 891 - RNA, 21 nt, Artificial Sequence
  siRNA antisense strand against APCS
auaaacuaguagcucauuauc

SEQ ID NO: 892 - RNA, 21 nt, Artificial Sequence
  siRNA antisense strand against APCS
uuauaaacuaguagcucauua

SEQ ID NO: 893 - RNA, 21 nt, Artificial Sequence
  siRNA antisense strand against APCS
uuuauaaacuaguagcucauu

SEQ ID NO: 894 - RNA, 21 nt, Artificial Sequence
  siRNA antisense strand against APCS
cuuuauaaacuaguagcucau

SEQ ID NO: 895 - RNA, 21 nt, Artificial Sequence
  siRNA antisense strand against APCS
ucuuuauaaacuaguagcuca

SEQ ID NO: 896 - RNA, 21 nt, Artificial Sequence
  siRNA antisense strand against APCS
uucuuuauaaacuaguagcuc

SEQ ID NO: 897 - RNA, 21 nt, Artificial Sequence
  siRNA antisense strand against APCS
uuucuuuauaaacuaguagcu

SEQ ID NO: 898 - RNA, 21 nt, Artificial Sequence
  siRNA antisense strand against APCS
aacucuuucuuuauaaacuag

SEQ ID NO: 899 - RNA, 21 nt, Artificial Sequence
  siRNA antisense strand against APCS
uacucuccaacucuuucuuua

SEQ ID NO: 900 - RNA, 21 nt, Artificial Sequence
  siRNA antisense strand against APCS
auacucuccaacucuuucuuu

SEQ ID NO: 901 - RNA, 21 nt, Artificial Sequence
  siRNA antisense strand against APCS
uauacucuccaacucuuucuu

SEQ ID NO: 902 - RNA, 21 nt, Artificial Sequence
  siRNA antisense strand against APCS
acuauacucuccaacucuuuc

SEQ ID NO: 903 - RNA, 21 nt, Artificial Sequence
  siRNA antisense strand against APCS
gacuauacucuccaacucuuu

SEQ ID NO: 904 - RNA, 21 nt, Artificial Sequence
  siRNA antisense strand against APCS
agacuauacucuccaacucuu

SEQ ID NO: 905 - RNA, 21 nt, Artificial Sequence
  siRNA antisense strand against APCS
uagacuauacucuccaacucu

SEQ ID NO: 906 - RNA, 21 nt, Artificial Sequence
  siRNA antisense strand against APCS
auagacuauacucuccaacuc

SEQ ID NO: 907 - RNA, 21 nt, Artificial Sequence
  siRNA antisense strand against APCS
uauagacuauacucuccaacu

SEQ ID NO: 908 - RNA, 21 nt, Artificial Sequence
  siRNA antisense strand against APCS
guauagacuauacucuccaac

SEQ ID NO: 909 - RNA, 21 nt, Artificial Sequence
  siRNA antisense strand against APCS
uguauagacuauacucuccaa

SEQ ID NO: 910 - RNA, 21 nt, Artificial Sequence
  siRNA antisense strand against APCS
auguauagacuauacucucca

SEQ ID NO: 911 - RNA, 21 nt, Artificial Sequence
  siRNA antisense strand against APCS
aauguauagacuauacucucc

SEQ ID NO: 912 - RNA, 21 nt, Artificial Sequence
  siRNA antisense strand against APCS
caauguauagacuauacucuc

SEQ ID NO: 913 - RNA, 21 nt, Artificial Sequence
  siRNA antisense strand against APCS
ccaauguauagacuauacucu

SEQ ID NO: 914 - RNA, 21 nt, Artificial Sequence
  siRNA antisense strand against APCS
uccaauguauagacuauacuc

SEQ ID NO: 915 - RNA, 21 nt, Artificial Sequence
  siRNA antisense strand against APCS
ugucuuccaauguauagacua

SEQ ID NO: 916 - RNA, 21 nt, Artificial Sequence
  siRNA antisense strand against APCS
ugugucuuccaauguauagac

SEQ ID NO: 917 - RNA, 21 nt, Artificial Sequence
  siRNA antisense strand against APCS
uugugucuuccaauguauaga

SEQ ID NO: 918 - RNA, 21 nt, Artificial Sequence
  siRNA antisense strand against APCS
uuugugucuuccaauguauag

SEQ ID NO: 919 - RNA, 21 nt, Artificial Sequence
  siRNA antisense strand against APCS
acuuugugucuuccaauguau

SEQ ID NO: 920 - RNA, 21 nt, Artificial Sequence
  siRNA antisense strand against APCS
aacuuugugucuuccaaugua

SEQ ID NO: 921 - RNA, 21 nt, Artificial Sequence
  siRNA antisense strand against APCS
uaacuuugugucuuccaaugu

SEQ ID NO: 922 - RNA, 21 nt, Artificial Sequence
  siRNA antisense strand against APCS
uguaacuuugugucuuccaau

SEQ ID NO: 923 - RNA, 21 nt, Artificial Sequence
  siRNA antisense strand against APCS
auguaacuuugugucuuccaa

SEQ ID NO: 924 - RNA, 21 nt, Artificial Sequence
  siRNA antisense strand against APCS
gauguaacuuugugucuucca

SEQ ID NO: 925 - RNA, 21 nt, Artificial Sequence
  siRNA antisense strand against APCS
ggauguaacuuugugucuucc

SEQ ID NO: 926 - RNA, 21 nt, Artificial Sequence
  siRNA antisense strand against APCS
uggauguaacuuugugucuuc

SEQ ID NO: 927 - RNA, 21 nt, Artificial Sequence
  siRNA antisense strand against APCS
uuggauguaacuuugugucuu

SEQ ID NO: 928 - RNA, 21 nt, Artificial Sequence
  siRNA antisense strand against APCS
uuuggauguaacuuugugucu

SEQ ID NO: 929 - RNA, 21 nt, Artificial Sequence
  siRNA antisense strand against APCS
cuuuggauguaacuuuguguc

SEQ ID NO: 930 - RNA, 21 nt, Artificial Sequence
  siRNA antisense strand against APCS
aacuuuggauguaacuuugug

SEQ ID NO: 931 - RNA, 21 nt, Artificial Sequence
  siRNA antisense strand against APCS
uaacuuuggauguaacuuugu

SEQ ID NO: 932 - RNA, 21 nt, Artificial Sequence
  siRNA antisense strand against APCS
auaacuuuggauguaacuuug

SEQ ID NO: 933 - RNA, 21 nt, Artificial Sequence
  siRNA antisense strand against APCS
gauaacuuuggauguaacuuu

SEQ ID NO: 934 - RNA, 21 nt, Artificial Sequence
  siRNA antisense strand against APCS
cgauaacuuuggauguaacuu

SEQ ID NO: 935 - RNA, 21 nt, Artificial Sequence
  siRNA antisense strand against APCS
ucgauaacuuuggauguaacu

SEQ ID NO: 936 - RNA, 21 nt, Artificial Sequence
  siRNA antisense strand against APCS
uucgauaacuuuggauguaac

SEQ ID NO: 937 - RNA, 21 nt, Artificial Sequence
  siRNA antisense strand against APCS
uuucgauaacuuuggauguaa

SEQ ID NO: 938 - RNA, 21 nt, Artificial Sequence
  siRNA antisense strand against APCS
uuuucgauaacuuuggaugua

SEQ ID NO: 939 - RNA, 21 nt, Artificial Sequence
  siRNA antisense strand against APCS
cuuuucgauaacuuuggaugu

SEQ ID NO: 940 - RNA, 21 nt, Artificial Sequence
  siRNA antisense strand against APCS
acuuuucgauaacuuuggaug

SEQ ID NO: 941 - RNA, 21 nt, Artificial Sequence
  siRNA antisense strand against APCS
aacuuuucgauaacuuuggau

SEQ ID NO: 942 - RNA, 21 nt, Artificial Sequence
  siRNA antisense strand against APCS
gaacuuuucgauaacuuugga

SEQ ID NO: 943 - RNA, 21 nt, Artificial Sequence
  siRNA antisense strand against APCS
uggagccgggaacuuuucgau

SEQ ID NO: 944 - RNA, 21 nt, Artificial Sequence
  siRNA antisense strand against APCS
acuggagccgggaacuuuucg

SEQ ID NO: 945 - RNA, 21 nt, Artificial Sequence
  siRNA antisense strand against APCS
gaugugcacuggagccgggaa

SEQ ID NO: 946 - RNA, 21 nt, Artificial Sequence
  siRNA antisense strand against APCS
cagaugugcacuggagccggg

SEQ ID NO: 947 - RNA, 21 nt, Artificial Sequence
  siRNA antisense strand against APCS
acagaugugcacuggagccgg

SEQ ID NO: 948 - RNA, 21 nt, Artificial Sequence
  siRNA antisense strand against APCS
cacagaugugcacuggagccg

SEQ ID NO: 949 - RNA, 21 nt, Artificial Sequence
  siRNA antisense strand against APCS
acacagaugugcacuggagcc

SEQ ID NO: 950 - RNA, 21 nt, Artificial Sequence
  siRNA antisense strand against APCS
ucacacagaugugcacuggag

SEQ ID NO: 951 - RNA, 21 nt, Artificial Sequence
  siRNA antisense strand against APCS
agcucacacagaugugcacug

SEQ ID NO: 952 - RNA, 21 nt, Artificial Sequence
  siRNA antisense strand against APCS
ccagcucacacagaugugcac

SEQ ID NO: 953 - RNA, 21 nt, Artificial Sequence
  siRNA antisense strand against APCS
ucccagcucacacagaugugc

SEQ ID NO: 954 - RNA, 21 nt, Artificial Sequence
  siRNA antisense strand against APCS
acucccagcucacacagaugu

SEQ ID NO: 955 - RNA, 21 nt, Artificial Sequence
  siRNA antisense strand against APCS
aggacucccagcucacacaga

SEQ ID NO: 956 - RNA, 21 nt, Artificial Sequence
  siRNA antisense strand against APCS
gaggacucccagcucacacag

SEQ ID NO: 957 - RNA, 21 nt, Artificial Sequence
  siRNA antisense strand against APCS
cugaugaggacucccagcuca

SEQ ID NO: 958 - RNA, 21 nt, Artificial Sequence
  siRNA antisense strand against APCS
ccugaugaggacucccagcuc

SEQ ID NO: 959 - RNA, 21 nt, Artificial Sequence
  siRNA antisense strand against APCS
accugaugaggacucccagcu

SEQ ID NO: 960 - RNA, 21 nt, Artificial Sequence
  siRNA antisense strand against APCS
uaccugaugaggacucccagc

SEQ ID NO: 961 - RNA, 21 nt, Artificial Sequence
  siRNA antisense strand against APCS
auaccugaugaggacucccag

SEQ ID NO: 962 - RNA, 21 nt, Artificial Sequence
  siRNA antisense strand against APCS
aauaccugaugaggacuccca

SEQ ID NO: 963 - RNA, 21 nt, Artificial Sequence
  siRNA antisense strand against APCS
caauaccugaugaggacuccc

SEQ ID NO: 964 - RNA, 21 nt, Artificial Sequence
  siRNA antisense strand against APCS
agcaauaccugaugaggacuc

SEQ ID NO: 965 - RNA, 21 nt, Artificial Sequence
  siRNA antisense strand against APCS
cagcaauaccugaugaggacu

SEQ ID NO: 966 - RNA, 21 nt, Artificial Sequence
  siRNA antisense strand against APCS
ucagcaauaccugaugaggac

SEQ ID NO: 967 - RNA, 21 nt, Artificial Sequence
  siRNA antisense strand against APCS
uucagcaauaccugaugagga

SEQ ID NO: 968 - RNA, 21 nt, Artificial Sequence
  siRNA antisense strand against APCS
auucagcaauaccugaugagg

SEQ ID NO: 969 - RNA, 21 nt, Artificial Sequence
  siRNA antisense strand against APCS
aauucagcaauaccugaugag

SEQ ID NO: 970 - RNA, 21 nt, Artificial Sequence
  siRNA antisense strand against APCS
aaauucagcaauaccugauga

SEQ ID NO: 971 - RNA, 21 nt, Artificial Sequence
  siRNA antisense strand against APCS
aaaauucagcaauaccugaug

SEQ ID NO: 972 - RNA, 21 nt, Artificial Sequence
  siRNA antisense strand against APCS
caaaauucagcaauaccugau

SEQ ID NO: 973 - RNA, 21 nt, Artificial Sequence
  siRNA antisense strand against APCS
ccaaaauucagcaauaccuga

SEQ ID NO: 974 - RNA, 21 nt, Artificial Sequence
  siRNA antisense strand against APCS
uccaaaauucagcaauaccug

SEQ ID NO: 975 - RNA, 21 nt, Artificial Sequence
  siRNA antisense strand against APCS
auccaaaauucagcaauaccu

SEQ ID NO: 976 - RNA, 21 nt, Artificial Sequence
  siRNA antisense strand against APCS
ugauccaaaauucagcaauac

SEQ ID NO: 977 - RNA, 21 nt, Artificial Sequence
  siRNA antisense strand against APCS
auugauccaaaauucagcaau

SEQ ID NO: 978 - RNA, 21 nt, Artificial Sequence
  siRNA antisense strand against APCS
cauugauccaaaauucagcaa

SEQ ID NO: 979 - RNA, 21 nt, Artificial Sequence
  siRNA antisense strand against APCS
ccauugauccaaaauucagca

SEQ ID NO: 980 - RNA, 21 nt, Artificial Sequence
  siRNA antisense strand against APCS
ucccauugauccaaaauucag

SEQ ID NO: 981 - RNA, 21 nt, Artificial Sequence
  siRNA antisense strand against APCS
aaaggugucccauugauccaa

SEQ ID NO: 982 - RNA, 21 nt, Artificial Sequence
  siRNA antisense strand against APCS
caccaaaggugucccauugau

SEQ ID NO: 983 - RNA, 21 nt, Artificial Sequence
  siRNA antisense strand against APCS
ucaccaaaggugucccauuga

SEQ ID NO: 984 - RNA, 21 nt, Artificial Sequence
  siRNA antisense strand against APCS
uucaccaaaggugucccauug

SEQ ID NO: 985 - RNA, 21 nt, Artificial Sequence
  siRNA antisense strand against APCS
uuucaccaaaggugucccauu

SEQ ID NO: 986 - RNA, 21 nt, Artificial Sequence
  siRNA antisense strand against APCS
uuuucaccaaaggugucccau

SEQ ID NO: 987 - RNA, 21 nt, Artificial Sequence
  siRNA antisense strand against APCS
uuuuucaccaaagguguccca

SEQ ID NO: 988 - RNA, 21 nt, Artificial Sequence
  siRNA antisense strand against APCS
acccuuuuucaccaaaggugu

SEQ ID NO: 989 - RNA, 21 nt, Artificial Sequence
  siRNA antisense strand against APCS
gacccuuuuucaccaaaggug

SEQ ID NO: 990 - RNA, 21 nt, Artificial Sequence
  siRNA antisense strand against APCS
agacccuuuuucaccaaaggu

SEQ ID NO: 991 - RNA, 21 nt, Artificial Sequence
  siRNA antisense strand against APCS
ucgcagacccuuuuucaccaa

SEQ ID NO: 992 - RNA, 21 nt, Artificial Sequence
  siRNA antisense strand against APCS
gucgcagacccuuuuucacca

SEQ ID NO: 993 - RNA, 21 nt, Artificial Sequence
  siRNA antisense strand against APCS
ugucgcagacccuuuuucacc

SEQ ID NO: 994 - RNA, 21 nt, Artificial Sequence
  siRNA antisense strand against APCS
cugucgcagacccuuuuucac

SEQ ID NO: 995 - RNA, 21 nt, Artificial Sequence
  siRNA antisense strand against APCS
acccugucgcagacccuuuuu

SEQ ID NO: 996 - RNA, 21 nt, Artificial Sequence
  siRNA antisense strand against APCS
aacccugucgcagacccuuuu

SEQ ID NO: 997 - RNA, 21 nt, Artificial Sequence
  siRNA antisense strand against APCS
uaacccugucgcagacccuuu

SEQ ID NO: 998 - RNA, 21 nt, Artificial Sequence
  siRNA antisense strand against APCS
guaacccugucgcagacccuu

SEQ ID NO: 999 - RNA, 21 nt, Artificial Sequence
  siRNA antisense strand against APCS
aguaacccugucgcagacccu

SEQ ID NO: 1000 - RNA, 21 nt, Artificial Sequence
  siRNA antisense strand against APCS
aaguaacccugucgcagaccc

SEQ ID NO: 1001 - RNA, 21 nt, Artificial Sequence
  siRNA antisense strand against APCS
aaaguaacccugucgcagacc

SEQ ID NO: 1002 - RNA, 21 nt, Artificial Sequence
  siRNA antisense strand against APCS
caaaguaacccugucgcagac

SEQ ID NO: 1003 - RNA, 21 nt, Artificial Sequence
  siRNA antisense strand against APCS
acaaaguaacccugucgcaga

SEQ ID NO: 1004 - RNA, 21 nt, Artificial Sequence
  siRNA antisense strand against APCS
uacaaaguaacccugucgcag

SEQ ID NO: 1005 - RNA, 21 nt, Artificial Sequence
  siRNA antisense strand against APCS
cuacaaaguaacccugucgca

SEQ ID NO: 1006 - RNA, 21 nt, Artificial Sequence
  siRNA antisense strand against APCS
ucuacaaaguaacccugucgc

SEQ ID NO: 1007 - RNA, 21 nt, Artificial Sequence
  siRNA antisense strand against APCS
uucuacaaaguaacccugucg

SEQ ID NO: 1008 - RNA, 21 nt, Artificial Sequence
  siRNA antisense strand against APCS
cuucuacaaaguaacccuguc

SEQ ID NO: 1009 - RNA, 21 nt, Artificial Sequence
  siRNA antisense strand against APCS
gcuucuacaaaguaacccugu

SEQ ID NO: 1010 - RNA, 21 nt, Artificial Sequence
  siRNA antisense strand against APCS
agcuucuacaaaguaacccug

SEQ ID NO: 1011 - RNA, 21 nt, Artificial Sequence
  siRNA antisense strand against APCS
gagcuucuacaaaguaacccu

SEQ ID NO: 1012 - RNA, 21 nt, Artificial Sequence
  siRNA antisense strand against APCS
ugagcuucuacaaaguaaccc

SEQ ID NO: 1013 - RNA, 21 nt, Artificial Sequence
  siRNA antisense strand against APCS
aaucuugggcugagcuucuac

SEQ ID NO: 1014 - RNA, 21 nt, Artificial Sequence
  siRNA antisense strand against APCS
caaucuugggcugagcuucua

SEQ ID NO: 1015 - RNA, 21 nt, Artificial Sequence
  siRNA antisense strand against APCS
acaaucuugggcugagcuucu

SEQ ID NO: 1016 - RNA, 21 nt, Artificial Sequence
  siRNA antisense strand against APCS
gacaaucuugggcugagcuuc

SEQ ID NO: 1017 - RNA, 21 nt, Artificial Sequence
  siRNA antisense strand against APCS
aggacaaucuugggcugagcu

SEQ ID NO: 1018 - RNA, 21 nt, Artificial Sequence
  siRNA antisense strand against APCS
cccaggacaaucuugggcuga

SEQ ID NO: 1019 - RNA, 21 nt, Artificial Sequence
  siRNA antisense strand against APCS
ugccccaggacaaucuugggc

SEQ ID NO: 1020 - RNA, 21 nt, Artificial Sequence
  siRNA antisense strand against APCS
cugccccaggacaaucuuggg

SEQ ID NO: 1021 - RNA, 21 nt, Artificial Sequence
  siRNA antisense strand against APCS
uccugccccaggacaaucuug

SEQ ID NO: 1022 - RNA, 21 nt, Artificial Sequence
  siRNA antisense strand against APCS
uuccugccccaggacaaucuu

SEQ ID NO: 1023 - RNA, 21 nt, Artificial Sequence
  siRNA antisense strand against APCS
uguuccugccccaggacaauc

SEQ ID NO: 1024 - RNA, 21 nt, Artificial Sequence
  siRNA antisense strand against APCS
uccuguuccugccccaggaca

SEQ ID NO: 1025 - RNA, 21 nt, Artificial Sequence
  siRNA antisense strand against APCS
aauccuguuccugccccagga

SEQ ID NO: 1026 - RNA, 21 nt, Artificial Sequence
  siRNA antisense strand against APCS
gaauccuguuccugccccagg

SEQ ID NO: 1027 - RNA, 21 nt, Artificial Sequence
  siRNA antisense strand against APCS
ggaauccuguuccugccccag

SEQ ID NO: 1028 - RNA, 21 nt, Artificial Sequence
  siRNA antisense strand against APCS
uaggaauccuguuccugcccc

SEQ ID NO: 1029 - RNA, 21 nt, Artificial Sequence
  siRNA antisense strand against APCS
auaggaauccuguuccugccc

SEQ ID NO: 1030 - RNA, 21 nt, Artificial Sequence
  siRNA antisense strand against APCS
cauaggaauccuguuccugcc

SEQ ID NO: 1031 - RNA, 21 nt, Artificial Sequence
  siRNA antisense strand against APCS
cccauaggaauccuguuccug

SEQ ID NO: 1032 - RNA, 21 nt, Artificial Sequence
  siRNA antisense strand against APCS
ccccauaggaauccuguuccu

SEQ ID NO: 1033 - RNA, 21 nt, Artificial Sequence
  siRNA antisense strand against APCS
gcccccauaggaauccuguuc

SEQ ID NO: 1034 - RNA, 21 nt, Artificial Sequence
  siRNA antisense strand against APCS
ugcccccauaggaauccuguu

SEQ ID NO: 1035 - RNA, 21 nt, Artificial Sequence
  siRNA antisense strand against APCS
cuugcccccauaggaauccug

SEQ ID NO: 1036 - RNA, 21 nt, Artificial Sequence
  siRNA antisense strand against APCS
acuugcccccauaggaauccu

SEQ ID NO: 1037 - RNA, 21 nt, Artificial Sequence
  siRNA antisense strand against APCS
aacuugcccccauaggaaucc

SEQ ID NO: 1038 - RNA, 21 nt, Artificial Sequence
  siRNA antisense strand against APCS
aaacuugcccccauaggaauc

SEQ ID NO: 1039 - RNA, 21 nt, Artificial Sequence
  siRNA antisense strand against APCS
caaacuugcccccauaggaau

SEQ ID NO: 1040 - RNA, 21 nt, Artificial Sequence
  siRNA antisense strand against APCS
ucaaacuugcccccauaggaa

SEQ ID NO: 1041 - RNA, 21 nt, Artificial Sequence
  siRNA antisense strand against APCS
aucaaacuugcccccauagga

SEQ ID NO: 1042 - RNA, 21 nt, Artificial Sequence
  siRNA antisense strand against APCS
uaucaaacuugcccccauagg

SEQ ID NO: 1043 - RNA, 21 nt, Artificial Sequence
  siRNA antisense strand against APCS
uccuaucaaacuugcccccau

SEQ ID NO: 1044 - RNA, 21 nt, Artificial Sequence
  siRNA antisense strand against APCS
cuccuaucaaacuugccccca

SEQ ID NO: 1045 - RNA, 21 nt, Artificial Sequence
  siRNA antisense strand against APCS
gcuccuaucaaacuugccccc

SEQ ID NO: 1046 - RNA, 21 nt, Artificial Sequence
  siRNA antisense strand against APCS
ggcuccuaucaaacuugcccc

SEQ ID NO: 1047 - RNA, 21 nt, Artificial Sequence
  siRNA antisense strand against APCS
uggcuccuaucaaacuugccc

SEQ ID NO: 1048 - RNA, 21 nt, Artificial Sequence
  siRNA antisense strand against APCS
cuggcuccuaucaaacuugcc

SEQ ID NO: 1049 - RNA, 21 nt, Artificial Sequence
  siRNA antisense strand against APCS
acuggcuccuaucaaacuugc

SEQ ID NO: 1050 - RNA, 21 nt, Artificial Sequence
  siRNA antisense strand against APCS
aaggacuggcuccuaucaaac

SEQ ID NO: 1051 - RNA, 21 nt, Artificial Sequence
  siRNA antisense strand against APCS
aaaggacuggcuccuaucaaa

SEQ ID NO: 1052 - RNA, 21 nt, Artificial Sequence
  siRNA antisense strand against APCS
caaaggacuggcuccuaucaa

SEQ ID NO: 1053 - RNA, 21 nt, Artificial Sequence
  siRNA antisense strand against APCS
acaaaggacuggcuccuauca

SEQ ID NO: 1054 - RNA, 21 nt, Artificial Sequence
  siRNA antisense strand against APCS
ccacaaaggacuggcuccuau

SEQ ID NO: 1055 - RNA, 21 nt, Artificial Sequence
  siRNA antisense strand against APCS
cccacaaaggacuggcuccua

SEQ ID NO: 1056 - RNA, 21 nt, Artificial Sequence
  siRNA antisense strand against APCS
ucccacaaaggacuggcuccu

SEQ ID NO: 1057 - RNA, 21 nt, Artificial Sequence
  siRNA antisense strand against APCS
cucccacaaaggacuggcucc

SEQ ID NO: 1058 - RNA, 21 nt, Artificial Sequence
  siRNA antisense strand against APCS
ucucccacaaaggacuggcuc

SEQ ID NO: 1059 - RNA, 21 nt, Artificial Sequence
  siRNA antisense strand against APCS
cucucccacaaaggacuggcu

SEQ ID NO: 1060 - RNA, 21 nt, Artificial Sequence
  siRNA antisense strand against APCS
ucucucccacaaaggacuggc

SEQ ID NO: 1061 - RNA, 21 nt, Artificial Sequence
  siRNA antisense strand against APCS
aucucucccacaaaggacugg

SEQ ID NO: 1062 - RNA, 21 nt, Artificial Sequence
  siRNA antisense strand against APCS
aaucucucccacaaaggacug

SEQ ID NO: 1063 - RNA, 21 nt, Artificial Sequence
  siRNA antisense strand against APCS
caaucucucccacaaaggacu

SEQ ID NO: 1064 - RNA, 21 nt, Artificial Sequence
  siRNA antisense strand against APCS
ccaaucucucccacaaaggac

SEQ ID NO: 1065 - RNA, 21 nt, Artificial Sequence
  siRNA antisense strand against APCS
cccaaucucucccacaaagga

SEQ ID NO: 1066 - RNA, 21 nt, Artificial Sequence
  siRNA antisense strand against APCS
uccccaaucucucccacaaag

SEQ ID NO: 1067 - RNA, 21 nt, Artificial Sequence
  siRNA antisense strand against APCS
auccccaaucucucccacaaa

SEQ ID NO: 1068 - RNA, 21 nt, Artificial Sequence
  siRNA antisense strand against APCS
aauccccaaucucucccacaa

SEQ ID NO: 1069 - RNA, 21 nt, Artificial Sequence
  siRNA antisense strand against APCS
aaauccccaaucucucccaca

SEQ ID NO: 1070 - RNA, 21 nt, Artificial Sequence
  siRNA antisense strand against APCS
caaauccccaaucucucccac

SEQ ID NO: 1071 - RNA, 21 nt, Artificial Sequence
  siRNA antisense strand against APCS
acaaauccccaaucucuccca

SEQ ID NO: 1072 - RNA, 21 nt, Artificial Sequence
  siRNA antisense strand against APCS
uacaaauccccaaucucuccc

SEQ ID NO: 1073 - RNA, 21 nt, Artificial Sequence
  siRNA antisense strand against APCS
guacaaauccccaaucucucc

SEQ ID NO: 1074 - RNA, 21 nt, Artificial Sequence
  siRNA antisense strand against APCS
uguacaaauccccaaucucuc

SEQ ID NO: 1075 - RNA, 21 nt, Artificial Sequence
  siRNA antisense strand against APCS
auguacaaauccccaaucucu

SEQ ID NO: 1076 - RNA, 21 nt, Artificial Sequence
  siRNA antisense strand against APCS
cccacauguacaaauccccaa

SEQ ID NO: 1077 - RNA, 21 nt, Artificial Sequence
  siRNA antisense strand against APCS
ucccacauguacaaaucccca

SEQ ID NO: 1078 - RNA, 21 nt, Artificial Sequence
  siRNA antisense strand against APCS
gucccacauguacaaaucccc

SEQ ID NO: 1079 - RNA, 21 nt, Artificial Sequence
  siRNA antisense strand against APCS
agucccacauguacaaauccc

SEQ ID NO: 1080 - RNA, 21 nt, Artificial Sequence
  siRNA antisense strand against APCS
acagagucccacauguacaaa

SEQ ID NO: 1081 - RNA, 21 nt, Artificial Sequence
  siRNA antisense strand against APCS
cacagagucccacauguacaa

SEQ ID NO: 1082 - RNA, 21 nt, Artificial Sequence
  siRNA antisense strand against APCS
agcacagagucccacauguac

SEQ ID NO: 1083 - RNA, 21 nt, Artificial Sequence
  siRNA antisense strand against APCS
gggggcagcacagagucccac

SEQ ID NO: 1084 - RNA, 21 nt, Artificial Sequence
  siRNA antisense strand against APCS
ugggggcagcacagaguccca

SEQ ID NO: 1085 - RNA, 21 nt, Artificial Sequence
  siRNA antisense strand against APCS
ucugggggcagcacagagucc

SEQ ID NO: 1086 - RNA, 21 nt, Artificial Sequence
  siRNA antisense strand against APCS
uucugggggcagcacagaguc

SEQ ID NO: 1087 - RNA, 21 nt, Artificial Sequence
  siRNA antisense strand against APCS
uuuucugggggcagcacagag

SEQ ID NO: 1088 - RNA, 21 nt, Artificial Sequence
  siRNA antisense strand against APCS
auuuucugggggcagcacaga

SEQ ID NO: 1089 - RNA, 21 nt, Artificial Sequence
  siRNA antisense strand against APCS
uauuuucugggggcagcacag

SEQ ID NO: 1090 - RNA, 21 nt, Artificial Sequence
  siRNA antisense strand against APCS
gauauuuucugggggcagcac

SEQ ID NO: 1091 - RNA, 21 nt, Artificial Sequence
  siRNA antisense strand against APCS
acaggauauuuucugggggca

SEQ ID NO: 1092 - RNA, 21 nt, Artificial Sequence
  siRNA antisense strand against APCS
agacaggauauuuucuggggg

SEQ ID NO: 1093 - RNA, 21 nt, Artificial Sequence
  siRNA antisense strand against APCS
cagacaggauauuuucugggg

SEQ ID NO: 1094 - RNA, 21 nt, Artificial Sequence
  siRNA antisense strand against APCS
gcagacaggauauuuucuggg

SEQ ID NO: 1095 - RNA, 21 nt, Artificial Sequence
  siRNA antisense strand against APCS
aggcagacaggauauuuucug

SEQ ID NO: 1096 - RNA, 21 nt, Artificial Sequence
  siRNA antisense strand against APCS
uaggcagacaggauauuuucu

SEQ ID NO: 1097 - RNA, 21 nt, Artificial Sequence
  siRNA antisense strand against APCS
auaggcagacaggauauuuuc

SEQ ID NO: 1098 - RNA, 21 nt, Artificial Sequence
  siRNA antisense strand against APCS
acccugauaggcagacaggau

SEQ ID NO: 1099 - RNA, 21 nt, Artificial Sequence
  siRNA antisense strand against APCS
uacccugauaggcagacagga

SEQ ID NO: 1100 - RNA, 21 nt, Artificial Sequence
  siRNA antisense strand against APCS
gguacccugauaggcagacag

SEQ ID NO: 1101 - RNA, 21 nt, Artificial Sequence
  siRNA antisense strand against APCS
agggguacccugauaggcaga

SEQ ID NO: 1102 - RNA, 21 nt, Artificial Sequence
  siRNA antisense strand against APCS
gagggguacccugauaggcag

SEQ ID NO: 1103 - RNA, 21 nt, Artificial Sequence
  siRNA antisense strand against APCS
agagggguacccugauaggca

SEQ ID NO: 1104 - RNA, 21 nt, Artificial Sequence
  siRNA antisense strand against APCS
gagagggguacccugauaggc

SEQ ID NO: 1105 - RNA, 21 nt, Artificial Sequence
  siRNA antisense strand against APCS
cagggagagggguacccugau

SEQ ID NO: 1106 - RNA, 21 nt, Artificial Sequence
  siRNA antisense strand against APCS
ggcagggagagggguacccug

SEQ ID NO: 1107 - RNA, 21 nt, Artificial Sequence
  siRNA antisense strand against APCS
uggcagggagagggguacccu

SEQ ID NO: 1108 - RNA, 21 nt, Artificial Sequence
  siRNA antisense strand against APCS
uuggcagggagagggguaccc

SEQ ID NO: 1109 - RNA, 21 nt, Artificial Sequence
  siRNA antisense strand against APCS
auuggcagggagagggguacc

SEQ ID NO: 1110 - RNA, 21 nt, Artificial Sequence
  siRNA antisense strand against APCS
auauuggcagggagaggggua

SEQ ID NO: 1111 - RNA, 21 nt, Artificial Sequence
  siRNA antisense strand against APCS
gauauuggcagggagaggggu

SEQ ID NO: 1112 - RNA, 21 nt, Artificial Sequence
  siRNA antisense strand against APCS
caguccaggauauuggcaggg

SEQ ID NO: 1113 - RNA, 21 nt, Artificial Sequence
  siRNA antisense strand against APCS
ugccaguccaggauauuggca

SEQ ID NO: 1114 - RNA, 21 nt, Artificial Sequence
  siRNA antisense strand against APCS
cugccaguccaggauauuggc

SEQ ID NO: 1115 - RNA, 21 nt, Artificial Sequence
  siRNA antisense strand against APCS
agagccugccaguccaggaua

SEQ ID NO: 1116 - RNA, 21 nt, Artificial Sequence
  siRNA antisense strand against APCS
cagagccugccaguccaggau

SEQ ID NO: 1117 - RNA, 21 nt, Artificial Sequence
  siRNA antisense strand against APCS
ucagagccugccaguccagga

SEQ ID NO: 1118 - RNA, 21 nt, Artificial Sequence
  siRNA antisense strand against APCS
uucagagccugccaguccagg

SEQ ID NO: 1119 - RNA, 21 nt, Artificial Sequence
  siRNA antisense strand against APCS
guucagagccugccaguccag

SEQ ID NO: 1120 - RNA, 21 nt, Artificial Sequence
  siRNA antisense strand against APCS
aguucagagccugccagucca

SEQ ID NO: 1121 - RNA, 21 nt, Artificial Sequence
  siRNA antisense strand against APCS
uaguucagagccugccagucc

SEQ ID NO: 1122 - RNA, 21 nt, Artificial Sequence
  siRNA antisense strand against APCS
auaguucagagccugccaguc

SEQ ID NO: 1123 - RNA, 21 nt, Artificial Sequence
  siRNA antisense strand against APCS
cauaguucagagccugccagu

SEQ ID NO: 1124 - RNA, 21 nt, Artificial Sequence
  siRNA antisense strand against APCS
ucauaguucagagccugccag

SEQ ID NO: 1125 - RNA, 21 nt, Artificial Sequence
  siRNA antisense strand against APCS
uucauaguucagagccugcca

SEQ ID NO: 1126 - RNA, 21 nt, Artificial Sequence
  siRNA antisense strand against APCS
uuucauaguucagagccugcc

SEQ ID NO: 1127 - RNA, 21 nt, Artificial Sequence
  siRNA antisense strand against APCS
auuucauaguucagagccugc

SEQ ID NO: 1128 - RNA, 21 nt, Artificial Sequence
  siRNA antisense strand against APCS
gauuucauaguucagagccug

SEQ ID NO: 1129 - RNA, 21 nt, Artificial Sequence
  siRNA antisense strand against APCS
ugauuucauaguucagagccu

SEQ ID NO: 1130 - RNA, 21 nt, Artificial Sequence
  siRNA antisense strand against APCS
cugauuucauaguucagagcc

SEQ ID NO: 1131 - RNA, 21 nt, Artificial Sequence
  siRNA antisense strand against APCS
ucugauuucauaguucagagc

SEQ ID NO: 1132 - RNA, 21 nt, Artificial Sequence
  siRNA antisense strand against APCS
uccucugauuucauaguucag

SEQ ID NO: 1133 - RNA, 21 nt, Artificial Sequence
  siRNA antisense strand against APCS
auccucugauuucauaguuca

SEQ ID NO: 1134 - RNA, 21 nt, Artificial Sequence
  siRNA antisense strand against APCS
uauccucugauuucauaguuc

SEQ ID NO: 1135 - RNA, 21 nt, Artificial Sequence
  siRNA antisense strand against APCS
auauccucugauuucauaguu

SEQ ID NO: 1136 - RNA, 21 nt, Artificial Sequence
  siRNA antisense strand against APCS
cauauccucugauuucauagu

SEQ ID NO: 1137 - RNA, 21 nt, Artificial Sequence
  siRNA antisense strand against APCS
gacauauccucugauuucaua

SEQ ID NO: 1138 - RNA, 21 nt, Artificial Sequence
  siRNA antisense strand against APCS
ugacauauccucugauuucau

SEQ ID NO: 1139 - RNA, 21 nt, Artificial Sequence
  siRNA antisense strand against APCS
augacauauccucugauuuca

SEQ ID NO: 1140 - RNA, 21 nt, Artificial Sequence
  siRNA antisense strand against APCS
gaugacauauccucugauuuc

SEQ ID NO: 1141 - RNA, 21 nt, Artificial Sequence
  siRNA antisense strand against APCS
gaugaugacauauccucugau

SEQ ID NO: 1142 - RNA, 21 nt, Artificial Sequence
  siRNA antisense strand against APCS
ugaugaugacauauccucuga

SEQ ID NO: 1143 - RNA, 21 nt, Artificial Sequence
  siRNA antisense strand against APCS
uugaugaugacauauccucug

SEQ ID NO: 1144 - RNA, 21 nt, Artificial Sequence
  siRNA antisense strand against APCS
uuugaugaugacauauccucu

SEQ ID NO: 1145 - RNA, 21 nt, Artificial Sequence
  siRNA antisense strand against APCS
guuugaugaugacauauccuc

SEQ ID NO: 1146 - RNA, 21 nt, Artificial Sequence
  siRNA antisense strand against APCS
gguuugaugaugacauauccu

SEQ ID NO: 1147 - RNA, 21 nt, Artificial Sequence
  siRNA antisense strand against APCS
aaggguuugaugaugacauau

SEQ ID NO: 1148 - RNA, 21 nt, Artificial Sequence
  siRNA antisense strand against APCS
caccaaggguuugaugaugac

SEQ ID NO: 1149 - RNA, 21 nt, Artificial Sequence
  siRNA antisense strand against APCS
cacaccaaggguuugaugaug

SEQ ID NO: 1150 - RNA, 21 nt, Artificial Sequence
  siRNA antisense strand against APCS
ucagacccacaccaaggguuu

SEQ ID NO: 1151 - RNA, 21 nt, Artificial Sequence
  siRNA antisense strand against APCS
cucagacccacaccaaggguu

SEQ ID NO: 1152 - RNA, 21 nt, Artificial Sequence
  siRNA antisense strand against APCS
ccucagacccacaccaagggu

SEQ ID NO: 1153 - RNA, 21 nt, Artificial Sequence
  siRNA antisense strand against APCS
accucagacccacaccaaggg

SEQ ID NO: 1154 - RNA, 21 nt, Artificial Sequence
  siRNA antisense strand against APCS
agaccucagacccacaccaag

SEQ ID NO: 1155 - RNA, 21 nt, Artificial Sequence
  siRNA antisense strand against APCS
aagaccucagacccacaccaa

SEQ ID NO: 1156 - RNA, 21 nt, Artificial Sequence
  siRNA antisense strand against APCS
caagaccucagacccacacca

SEQ ID NO: 1157 - RNA, 21 nt, Artificial Sequence
  siRNA antisense strand against APCS
ucaagaccucagacccacacc

SEQ ID NO: 1158 - RNA, 21 nt, Artificial Sequence
  siRNA antisense strand against APCS
gucaagaccucagacccacac

SEQ ID NO: 1159 - RNA, 21 nt, Artificial Sequence
  siRNA antisense strand against APCS
gagucaagaccucagacccac

SEQ ID NO: 1160 - RNA, 21 nt, Artificial Sequence
  siRNA antisense strand against APCS
ugagucaagaccucagaccca

SEQ ID NO: 1161 - RNA, 21 nt, Artificial Sequence
  siRNA antisense strand against APCS
uugagucaagaccucagaccc

SEQ ID NO: 1162 - RNA, 21 nt, Artificial Sequence
  siRNA antisense strand against APCS
cguugagucaagaccucagac

SEQ ID NO: 1163 - RNA, 21 nt, Artificial Sequence
  siRNA antisense strand against APCS
ucguugagucaagaccucaga

SEQ ID NO: 1164 - RNA, 21 nt, Artificial Sequence
  siRNA antisense strand against APCS
cucguugagucaagaccucag

SEQ ID NO: 1165 - RNA, 21 nt, Artificial Sequence
  siRNA antisense strand against APCS
ucucguugagucaagaccuca

SEQ ID NO: 1166 - RNA, 21 nt, Artificial Sequence
  siRNA antisense strand against APCS
cucucguugagucaagaccuc

SEQ ID NO: 1167 - RNA, 21 nt, Artificial Sequence
  siRNA antisense strand against APCS
gcucucguugagucaagaccu

SEQ ID NO: 1168 - RNA, 21 nt, Artificial Sequence
  siRNA antisense strand against APCS
ugcucucguugagucaagacc

SEQ ID NO: 1169 - RNA, 21 nt, Artificial Sequence
  siRNA antisense strand against APCS
gugcucucguugagucaagac

SEQ ID NO: 1170 - RNA, 21 nt, Artificial Sequence
  siRNA antisense strand against APCS
agugcucucguugagucaaga

SEQ ID NO: 1171 - RNA, 21 nt, Artificial Sequence
  siRNA antisense strand against APCS
aagugcucucguugagucaag

SEQ ID NO: 1172 - RNA, 21 nt, Artificial Sequence
  siRNA antisense strand against APCS
caagugcucucguugagucaa

SEQ ID NO: 1173 - RNA, 21 nt, Artificial Sequence
  siRNA antisense strand against APCS
ucaagugcucucguugaguca

SEQ ID NO: 1174 - RNA, 21 nt, Artificial Sequence
  siRNA antisense strand against APCS
uucaagugcucucguugaguc

SEQ ID NO: 1175 - RNA, 21 nt, Artificial Sequence
  siRNA antisense strand against APCS
uuucaagugcucucguugagu

SEQ ID NO: 1176 - RNA, 21 nt, Artificial Sequence
  siRNA antisense strand against APCS
uuuucaagugcucucguugag

SEQ ID NO: 1177 - RNA, 21 nt, Artificial Sequence
  siRNA antisense strand against APCS
auuuucaagugcucucguuga

SEQ ID NO: 1178 - RNA, 21 nt, Artificial Sequence
  siRNA antisense strand against APCS
cauuuucaagugcucucguug

SEQ ID NO: 1179 - RNA, 21 nt, Artificial Sequence
  siRNA antisense strand against APCS
ucauuuucaagugcucucguu

SEQ ID NO: 1180 - RNA, 21 nt, Artificial Sequence
  siRNA antisense strand against APCS
uucauuuucaagugcucucgu

SEQ ID NO: 1181 - RNA, 21 nt, Artificial Sequence
  siRNA antisense strand against APCS
uuucauuuucaagugcucucg

SEQ ID NO: 1182 - RNA, 21 nt, Artificial Sequence
  siRNA antisense strand against APCS
auuucauuuucaagugcucuc

SEQ ID NO: 1183 - RNA, 21 nt, Artificial Sequence
  siRNA antisense strand against APCS
cauuucauuuucaagugcucu

SEQ ID NO: 1184 - RNA, 21 nt, Artificial Sequence
  siRNA antisense strand against APCS
ucauuucauuuucaagugcuc

SEQ ID NO: 1185 - RNA, 21 nt, Artificial Sequence
  siRNA antisense strand against APCS
gucauuucauuuucaagugcu

SEQ ID NO: 1186 - RNA, 21 nt, Artificial Sequence
  siRNA antisense strand against APCS
agucauuucauuuucaagugc

SEQ ID NO: 1187 - RNA, 21 nt, Artificial Sequence
  siRNA antisense strand against APCS
cagucauuucauuuucaagug

SEQ ID NO: 1188 - RNA, 21 nt, Artificial Sequence
  siRNA antisense strand against APCS
acagucauuucauuuucaagu

SEQ ID NO: 1189 - RNA, 21 nt, Artificial Sequence
  siRNA antisense strand against APCS
gacagucauuucauuuucaag

SEQ ID NO: 1190 - RNA, 21 nt, Artificial Sequence
  siRNA antisense strand against APCS
agacagucauuucauuuucaa

SEQ ID NO: 1191 - RNA, 21 nt, Artificial Sequence
  siRNA antisense strand against APCS
uagacagucauuucauuuuca

SEQ ID NO: 1192 - RNA, 21 nt, Artificial Sequence
  siRNA antisense strand against APCS
uuagacagucauuucauuuuc

SEQ ID NO: 1193 - RNA, 21 nt, Artificial Sequence
  siRNA antisense strand against APCS
cuuagacagucauuucauuuu

SEQ ID NO: 1194 - RNA, 21 nt, Artificial Sequence
  siRNA antisense strand against APCS
ucuuagacagucauuucauuu

SEQ ID NO: 1195 - RNA, 21 nt, Artificial Sequence
  siRNA antisense strand against APCS
cucuuagacagucauuucauu

SEQ ID NO: 1196 - RNA, 21 nt, Artificial Sequence
  siRNA antisense strand against APCS
ucucuuagacagucauuucau

SEQ ID NO: 1197 - RNA, 21 nt, Artificial Sequence
  siRNA antisense strand against APCS
aucucuuagacagucauuuca

SEQ ID NO: 1198 - RNA, 21 nt, Artificial Sequence
  siRNA antisense strand against APCS
agaucucuuagacagucauuu

SEQ ID NO: 1199 - RNA, 21 nt, Artificial Sequence
  siRNA antisense strand against APCS
cagaucucuuagacagucauu

SEQ ID NO: 1200 - RNA, 21 nt, Artificial Sequence
  siRNA antisense strand against APCS
ccagaucucuuagacagucau

SEQ ID NO: 1201 - RNA, 21 nt, Artificial Sequence
  siRNA antisense strand against APCS
accagaucucuuagacaguca

SEQ ID NO: 1202 - RNA, 21 nt, Artificial Sequence
  siRNA antisense strand against APCS
gaccagaucucuuagacaguc

SEQ ID NO: 1203 - RNA, 21 nt, Artificial Sequence
  siRNA antisense strand against APCS
ugaccagaucucuuagacagu

SEQ ID NO: 1204 - RNA, 21 nt, Artificial Sequence
  siRNA antisense strand against APCS
uugaccagaucucuuagacag

SEQ ID NO: 1205 - RNA, 21 nt, Artificial Sequence
  siRNA antisense strand against APCS
uuugaccagaucucuuagaca

SEQ ID NO: 1206 - RNA, 21 nt, Artificial Sequence
  siRNA antisense strand against APCS
cuuugaccagaucucuuagac

SEQ ID NO: 1207 - RNA, 21 nt, Artificial Sequence
  siRNA antisense strand against APCS
gcuuugaccagaucucuuaga

SEQ ID NO: 1208 - RNA, 21 nt, Artificial Sequence
  siRNA antisense strand against APCS
ugcuuugaccagaucucuuag

SEQ ID NO: 1209 - RNA, 21 nt, Artificial Sequence
  siRNA antisense strand against APCS
uugcuuugaccagaucucuua

SEQ ID NO: 1210 - RNA, 21 nt, Artificial Sequence
  siRNA antisense strand against APCS
guugcuuugaccagaucucuu

SEQ ID NO: 1211 - RNA, 21 nt, Artificial Sequence
  siRNA antisense strand against APCS
aguugcuuugaccagaucucu

SEQ ID NO: 1212 - RNA, 21 nt, Artificial Sequence
  siRNA antisense strand against APCS
caguugcuuugaccagaucuc

SEQ ID NO: 1213 - RNA, 21 nt, Artificial Sequence
  siRNA antisense strand against APCS
ccaguugcuuugaccagaucu

SEQ ID NO: 1214 - RNA, 21 nt, Artificial Sequence
  siRNA antisense strand against APCS
uccaguugcuuugaccagauc

SEQ ID NO: 1215 - RNA, 21 nt, Artificial Sequence
  siRNA antisense strand against APCS
auccaguugcuuugaccagau

SEQ ID NO: 1216 - RNA, 21 nt, Artificial Sequence
  siRNA antisense strand against APCS
uauccaguugcuuugaccaga

SEQ ID NO: 1217 - RNA, 21 nt, Artificial Sequence
  siRNA antisense strand against APCS
guauccaguugcuuugaccag

SEQ ID NO: 1218 - RNA, 21 nt, Artificial Sequence
  siRNA antisense strand against APCS
aguauccaguugcuuugacca

SEQ ID NO: 1219 - RNA, 21 nt, Artificial Sequence
  siRNA antisense strand against APCS
uaguauccaguugcuuugacc

SEQ ID NO: 1220 - RNA, 21 nt, Artificial Sequence
  siRNA antisense strand against APCS
cuaguauccaguugcuuugac

SEQ ID NO: 1221 - RNA, 21 nt, Artificial Sequence
  siRNA antisense strand against APCS
ucuaguauccaguugcuuuga

SEQ ID NO: 1222 - RNA, 21 nt, Artificial Sequence
  siRNA antisense strand against APCS
aucuaguauccaguugcuuug

SEQ ID NO: 1223 - RNA, 21 nt, Artificial Sequence
  siRNA antisense strand against APCS
gaucuaguauccaguugcuuu

SEQ ID NO: 1224 - RNA, 21 nt, Artificial Sequence
  siRNA antisense strand against APCS
agaucuaguauccaguugcuu

SEQ ID NO: 1225 - RNA, 21 nt, Artificial Sequence
  siRNA antisense strand against APCS
aagaucuaguauccaguugcu

SEQ ID NO: 1226 - RNA, 21 nt, Artificial Sequence
  siRNA antisense strand against APCS
uaagaucuaguauccaguugc

SEQ ID NO: 1227 - RNA, 21 nt, Artificial Sequence
  siRNA antisense strand against APCS
guaagaucuaguauccaguug

SEQ ID NO: 1228 - RNA, 21 nt, Artificial Sequence
  siRNA antisense strand against APCS
uguaagaucuaguauccaguu

SEQ ID NO: 1229 - RNA, 21 nt, Artificial Sequence
  siRNA antisense strand against APCS
auguaagaucuaguauccagu

SEQ ID NO: 1230 - RNA, 21 nt, Artificial Sequence
  siRNA antisense strand against APCS
gauguaagaucuaguauccag

SEQ ID NO: 1231 - RNA, 21 nt, Artificial Sequence
  siRNA antisense strand against APCS
agauguaagaucuaguaucca

SEQ ID NO: 1232 - RNA, 21 nt, Artificial Sequence
  siRNA antisense strand against APCS
cagauguaagaucuaguaucc

SEQ ID NO: 1233 - RNA, 21 nt, Artificial Sequence
  siRNA antisense strand against APCS
ugcagauguaagaucuaguau

SEQ ID NO: 1234 - RNA, 21 nt, Artificial Sequence
  siRNA antisense strand against APCS
cugcagauguaagaucuagua

SEQ ID NO: 1235 - RNA, 21 nt, Artificial Sequence
  siRNA antisense strand against APCS
agcugcagauguaagaucuag

SEQ ID NO: 1236 - RNA, 21 nt, Artificial Sequence
  siRNA antisense strand against APCS
gagcugcagauguaagaucua

SEQ ID NO: 1237 - RNA, 21 nt, Artificial Sequence
  siRNA antisense strand against APCS
agagcugcagauguaagaucu

SEQ ID NO: 1238 - RNA, 21 nt, Artificial Sequence
  siRNA antisense strand against APCS
aagagcugcagauguaagauc

SEQ ID NO: 1239 - RNA, 21 nt, Artificial Sequence
  siRNA antisense strand against APCS
aaagagcugcagauguaagau

SEQ ID NO: 1240 - RNA, 21 nt, Artificial Sequence
  siRNA antisense strand against APCS
gaaagagcugcagauguaaga

SEQ ID NO: 1241 - RNA, 21 nt, Artificial Sequence
  siRNA antisense strand against APCS
agaaagagcugcagauguaag

SEQ ID NO: 1242 - RNA, 21 nt, Artificial Sequence
  siRNA antisense strand against APCS
aagaaagagcugcagauguaa

SEQ ID NO: 1243 - RNA, 21 nt, Artificial Sequence
  siRNA antisense strand against APCS
gaagaaagagcugcagaugua

SEQ ID NO: 1244 - RNA, 21 nt, Artificial Sequence
  siRNA antisense strand against APCS
agaagaaagagcugcagaugu

SEQ ID NO: 1245 - RNA, 21 nt, Artificial Sequence
  siRNA antisense strand against APCS
aagaagaaagagcugcagaug

SEQ ID NO: 1246 - RNA, 21 nt, Artificial Sequence
  siRNA antisense strand against APCS
aaagaagaaagagcugcagau

SEQ ID NO: 1247 - RNA, 21 nt, Artificial Sequence
  siRNA antisense strand against APCS
caaagaagaaagagcugcaga

SEQ ID NO: 1248 - RNA, 21 nt, Artificial Sequence
  siRNA antisense strand against APCS
ucaaagaagaaagagcugcag

SEQ ID NO: 1249 - RNA, 21 nt, Artificial Sequence
  siRNA antisense strand against APCS
uucaaagaagaaagagcugca

SEQ ID NO: 1250 - RNA, 21 nt, Artificial Sequence
  siRNA antisense strand against APCS
auucaaagaagaaagagcugc

SEQ ID NO: 1251 - RNA, 21 nt, Artificial Sequence
  siRNA antisense strand against APCS
aauucaaagaagaaagagcug

SEQ ID NO: 1252 - RNA, 21 nt, Artificial Sequence
  siRNA antisense strand against APCS
aaauucaaagaagaaagagcu

SEQ ID NO: 1253 - RNA, 21 nt, Artificial Sequence
  siRNA antisense strand against APCS
gaaauucaaagaagaaagagc

SEQ ID NO: 1254 - RNA, 21 nt, Artificial Sequence
  siRNA antisense strand against APCS
ggaaauucaaagaagaaagag

SEQ ID NO: 1255 - RNA, 21 nt, Artificial Sequence
  siRNA antisense strand against APCS
aggaaauucaaagaagaaaga

SEQ ID NO: 1256 - RNA, 21 nt, Artificial Sequence
  siRNA antisense strand against APCS
uaggaaauucaaagaagaaag

SEQ ID NO: 1257 - RNA, 21 nt, Artificial Sequence
  siRNA antisense strand against APCS
auaggaaauucaaagaagaaa

SEQ ID NO: 1258 - RNA, 21 nt, Artificial Sequence
  siRNA antisense strand against APCS
agauaggaaauucaaagaaga

SEQ ID NO: 1259 - RNA, 21 nt, Artificial Sequence
  siRNA antisense strand against APCS
cagauaggaaauucaaagaag

SEQ ID NO: 1260 - RNA, 21 nt, Artificial Sequence
  siRNA antisense strand against APCS
acagauaggaaauucaaagaa

SEQ ID NO: 1261 - RNA, 21 nt, Artificial Sequence
  siRNA antisense strand against APCS
uacagauaggaaauucaaaga

SEQ ID NO: 1262 - RNA, 21 nt, Artificial Sequence
  siRNA antisense strand against APCS
auacagauaggaaauucaaag

SEQ ID NO: 1263 - RNA, 21 nt, Artificial Sequence
  siRNA antisense strand against APCS
cauacagauaggaaauucaaa

SEQ ID NO: 1264 - RNA, 21 nt, Artificial Sequence
  siRNA antisense strand against APCS
acauacagauaggaaauucaa

SEQ ID NO: 1265 - RNA, 21 nt, Artificial Sequence
  siRNA antisense strand against APCS
agacauacagauaggaaauuc

SEQ ID NO: 1266 - RNA, 21 nt, Artificial Sequence
  siRNA antisense strand against APCS
cagacauacagauaggaaauu

SEQ ID NO: 1267 - RNA, 21 nt, Artificial Sequence
  siRNA antisense strand against APCS
gcagacauacagauaggaaau

SEQ ID NO: 1268 - RNA, 21 nt, Artificial Sequence
  siRNA antisense strand against APCS
ggcagacauacagauaggaaa

SEQ ID NO: 1269 - RNA, 21 nt, Artificial Sequence
  siRNA antisense strand against APCS
aggcagacauacagauaggaa

SEQ ID NO: 1270 - RNA, 21 nt, Artificial Sequence
  siRNA antisense strand against APCS
uaggcagacauacagauagga

SEQ ID NO: 1271 - RNA, 21 nt, Artificial Sequence
  siRNA antisense strand against APCS
uuaggcagacauacagauagg

SEQ ID NO: 1272 - RNA, 21 nt, Artificial Sequence
  siRNA antisense strand against APCS
auuaggcagacauacagauag

SEQ ID NO: 1273 - RNA, 21 nt, Artificial Sequence
  siRNA antisense strand against APCS
aauuaggcagacauacagaua

SEQ ID NO: 1274 - RNA, 21 nt, Artificial Sequence
  siRNA antisense strand against APCS
uaauuaggcagacauacagau

SEQ ID NO: 1275 - RNA, 21 nt, Artificial Sequence
  siRNA antisense strand against APCS
uuaauuaggcagacauacaga

SEQ ID NO: 1276 - RNA, 21 nt, Artificial Sequence
  siRNA antisense strand against APCS
uuuaauuaggcagacauacag

SEQ ID NO: 1277 - RNA, 21 nt, Artificial Sequence
  siRNA antisense strand against APCS
uuuuaauuaggcagacauaca

SEQ ID NO: 1278 - RNA, 21 nt, Artificial Sequence
  siRNA antisense strand against APCS
uuuuuaauuaggcagacauac

SEQ ID NO: 1279 - RNA, 21 nt, Artificial Sequence
  siRNA antisense strand against APCS
uuuuuuaauuaggcagacaua

SEQ ID NO: 1280 - RNA, 21 nt, Artificial Sequence
  siRNA antisense strand against APCS
uuuuuuuaauuaggcagacau

SEQ ID NO: 1281 - RNA, 21 nt, Artificial Sequence
  siRNA antisense strand against APCS
auuuuuuuaauuaggcagaca

SEQ ID NO: 1282 - RNA, 21 nt, Artificial Sequence
  siRNA antisense strand against APCS
uauuuuuuuaauuaggcagac

SEQ ID NO: 1283 - RNA, 21 nt, Artificial Sequence
  siRNA antisense strand against APCS
auauuuuuuuaauuaggcaga

SEQ ID NO: 1284 - RNA, 21 nt, Artificial Sequence
  siRNA antisense strand against APCS
uauauuuuuuuaauuaggcag

SEQ ID NO: 1285 - RNA, 21 nt, Artificial Sequence
  siRNA antisense strand against APCS
auauauuuuuuuaauuaggca

SEQ ID NO: 1286 - RNA, 21 nt, Artificial Sequence
  siRNA antisense strand against APCS
uauauauuuuuuuaauuaggc

SEQ ID NO: 1287 - RNA, 21 nt, Artificial Sequence
  siRNA antisense strand against APCS
uacaauauauauuuuuuuaau

SEQ ID NO: 1288 - RNA, 19 nt, Homo sapiens
gcaugaauaucagacgcua

SEQ ID NO: 1289 - RNA, 19 nt, Homo sapiens
caugaauaucagacgcuag

SEQ ID NO: 1290 - RNA, 19 nt, Homo sapiens
auaucagacgcuaggggga

SEQ ID NO: 1291 - RNA, 19 nt, Homo sapiens
cuagggggacagccacugu

SEQ ID NO: 1292 - RNA, 19 nt, Homo sapiens
agggggacagccacugugu

SEQ ID NO: 1293 - RNA, 19 nt, Homo sapiens
ggggacagccacuguguug

SEQ ID NO: 1294 - RNA, 19 nt, Homo sapiens
gggacagccacuguguugu

SEQ ID NO: 1295 - RNA, 19 nt, Homo sapiens
ggacagccacuguguuguc

SEQ ID NO: 1296 - RNA, 19 nt, Homo sapiens
gacagccacuguguugucu

SEQ ID NO: 1297 - RNA, 19 nt, Homo sapiens
gccacuguguugucugcua

SEQ ID NO: 1298 - RNA, 19 nt, Homo sapiens
ccacuguguugucugcuac

SEQ ID NO: 1299 - RNA, 19 nt, Homo sapiens
cacuguguugucugcuacc

SEQ ID NO: 1300 - RNA, 19 nt, Homo sapiens
cuguguugucugcuacccu

SEQ ID NO: 1301 - RNA, 19 nt, Homo sapiens
uguguugucugcuacccuc

SEQ ID NO: 1302 - RNA, 19 nt, Homo sapiens
guguugucugcuacccuca

SEQ ID NO: 1303 - RNA, 19 nt, Homo sapiens
uguugucugcuacccucau

SEQ ID NO: 1304 - RNA, 19 nt, Homo sapiens
guugucugcuacccucauc

SEQ ID NO: 1305 - RNA, 19 nt, Homo sapiens
gucugcuacccucauccug

SEQ ID NO: 1306 - RNA, 19 nt, Homo sapiens
cugcuacccucauccuggu

SEQ ID NO: 1307 - RNA, 19 nt, Homo sapiens
gcuacccucauccugguca

SEQ ID NO: 1308 - RNA, 19 nt, Homo sapiens
cuacccucauccuggucac

SEQ ID NO: 1309 - RNA, 19 nt, Homo sapiens
uacccucauccuggucacu

SEQ ID NO: 1310 - RNA, 19 nt, Homo sapiens
acccucauccuggucacug

SEQ ID NO: 1311 - RNA, 19 nt, Homo sapiens
cccucauccuggucacugc

SEQ ID NO: 1312 - RNA, 19 nt, Homo sapiens
ccucauccuggucacugcu

SEQ ID NO: 1313 - RNA, 19 nt, Homo sapiens
cucauccuggucacugcuu

SEQ ID NO: 1314 - RNA, 19 nt, Homo sapiens
cauccuggucacugcuucu

SEQ ID NO: 1315 - RNA, 19 nt, Homo sapiens
auccuggucacugcuucug

SEQ ID NO: 1316 - RNA, 19 nt, Homo sapiens
uccuggucacugcuucugc

SEQ ID NO: 1317 - RNA, 19 nt, Homo sapiens
ccuggucacugcuucugcu

SEQ ID NO: 1318 - RNA, 19 nt, Homo sapiens
cuggucacugcuucugcua

SEQ ID NO: 1319 - RNA, 19 nt, Homo sapiens
uggucacugcuucugcuau

SEQ ID NO: 1320 - RNA, 19 nt, Homo sapiens
ggucacugcuucugcuaua

SEQ ID NO: 1321 - RNA, 19 nt, Homo sapiens
gucacugcuucugcuauaa

SEQ ID NO: 1322 - RNA, 19 nt, Homo sapiens
cacugcuucugcuauaaca

SEQ ID NO: 1323 - RNA, 19 nt, Homo sapiens
acugcuucugcuauaacag

SEQ ID NO: 1324 - RNA, 19 nt, Homo sapiens
cugcuucugcuauaacagc

SEQ ID NO: 1325 - RNA, 19 nt, Homo sapiens
gcuucugcuauaacagccc

SEQ ID NO: 1326 - RNA, 19 nt, Homo sapiens
cuucugcuauaacagcccu

SEQ ID NO: 1327 - RNA, 19 nt, Homo sapiens
uucugcuauaacagcccua

SEQ ID NO: 1328 - RNA, 19 nt, Homo sapiens
ucugcuauaacagcccuag

SEQ ID NO: 1329 - RNA, 19 nt, Homo sapiens
cugcuauaacagcccuagg

SEQ ID NO: 1330 - RNA, 19 nt, Homo sapiens
ugcuauaacagcccuaggc

SEQ ID NO: 1331 - RNA, 19 nt, Homo sapiens
gcuauaacagcccuaggcc

SEQ ID NO: 1332 - RNA, 19 nt, Homo sapiens
cuauaacagcccuaggcca

SEQ ID NO: 1333 - RNA, 19 nt, Homo sapiens
uauaacagcccuaggccag

SEQ ID NO: 1334 - RNA, 19 nt, Homo sapiens
auaacagcccuaggccagg

SEQ ID NO: 1335 - RNA, 19 nt, Homo sapiens
uaacagcccuaggccagga

SEQ ID NO: 1336 - RNA, 19 nt, Homo sapiens
acagcccuaggccaggaau

SEQ ID NO: 1337 - RNA, 19 nt, Homo sapiens
cagcccuaggccaggaaua

SEQ ID NO: 1338 - RNA, 19 nt, Homo sapiens
agcccuaggccaggaauau

SEQ ID NO: 1339 - RNA, 19 nt, Homo sapiens
gcccuaggccaggaauaug

SEQ ID NO: 1340 - RNA, 19 nt, Homo sapiens
cccuaggccaggaauauga

SEQ ID NO: 1341 - RNA, 19 nt, Homo sapiens
ccuaggccaggaauaugaa

SEQ ID NO: 1342 - RNA, 19 nt, Homo sapiens
cuaggccaggaauaugaac

SEQ ID NO: 1343 - RNA, 19 nt, Homo sapiens
uaggccaggaauaugaaca

SEQ ID NO: 1344 - RNA, 19 nt, Homo sapiens
aggccaggaauaugaacaa

SEQ ID NO: 1345 - RNA, 19 nt, Homo sapiens
ggccaggaauaugaacaag

SEQ ID NO: 1346 - RNA, 19 nt, Homo sapiens
gccaggaauaugaacaagc

SEQ ID NO: 1347 - RNA, 19 nt, Homo sapiens
ccaggaauaugaacaagcc

SEQ ID NO: 1348 - RNA, 19 nt, Homo sapiens
caggaauaugaacaagccg

SEQ ID NO: 1349 - RNA, 19 nt, Homo sapiens
aggaauaugaacaagccgc

SEQ ID NO: 1350 - RNA, 19 nt, Homo sapiens
ggaauaugaacaagccgcu

SEQ ID NO: 1351 - RNA, 19 nt, Homo sapiens
gaauaugaacaagccgcug

SEQ ID NO: 1352 - RNA, 19 nt, Homo sapiens
aauaugaacaagccgcugc

SEQ ID NO: 1353 - RNA, 19 nt, Homo sapiens
auaugaacaagccgcugcu

SEQ ID NO: 1354 - RNA, 19 nt, Homo sapiens
uaugaacaagccgcugcuu

SEQ ID NO: 1355 - RNA, 19 nt, Homo sapiens
augaacaagccgcugcuuu

SEQ ID NO: 1356 - RNA, 19 nt, Homo sapiens
ugaacaagccgcugcuuug

SEQ ID NO: 1357 - RNA, 19 nt, Homo sapiens
gaacaagccgcugcuuugg

SEQ ID NO: 1358 - RNA, 19 nt, Homo sapiens
aacaagccgcugcuuugga

SEQ ID NO: 1359 - RNA, 19 nt, Homo sapiens
acaagccgcugcuuuggau

SEQ ID NO: 1360 - RNA, 19 nt, Homo sapiens
caagccgcugcuuuggauc

SEQ ID NO: 1361 - RNA, 19 nt, Homo sapiens
aagccgcugcuuuggaucu

SEQ ID NO: 1362 - RNA, 19 nt, Homo sapiens
agccgcugcuuuggaucuc

SEQ ID NO: 1363 - RNA, 19 nt, Homo sapiens
gccgcugcuuuggaucucu

SEQ ID NO: 1364 - RNA, 19 nt, Homo sapiens
ccgcugcuuuggaucucug

SEQ ID NO: 1365 - RNA, 19 nt, Homo sapiens
cgcugcuuuggaucucugu

SEQ ID NO: 1366 - RNA, 19 nt, Homo sapiens
gcugcuuuggaucucuguc

SEQ ID NO: 1367 - RNA, 19 nt, Homo sapiens
cugcuuuggaucucugucc

SEQ ID NO: 1368 - RNA, 19 nt, Homo sapiens
ugcuuuggaucucuguccu

SEQ ID NO: 1369 - RNA, 19 nt, Homo sapiens
gcuuuggaucucuguccuc

SEQ ID NO: 1370 - RNA, 19 nt, Homo sapiens
cuuuggaucucuguccuca

SEQ ID NO: 1371 - RNA, 19 nt, Homo sapiens
uuuggaucucuguccucac

SEQ ID NO: 1372 - RNA, 19 nt, Homo sapiens
ggaucucuguccucaccag

SEQ ID NO: 1373 - RNA, 19 nt, Homo sapiens
gaucucuguccucaccagc

SEQ ID NO: 1374 - RNA, 19 nt, Homo sapiens
cucuguccucaccagccuc

SEQ ID NO: 1375 - RNA, 19 nt, Homo sapiens
cuguccucaccagccuccu

SEQ ID NO: 1376 - RNA, 19 nt, Homo sapiens
uguccucaccagccuccug

SEQ ID NO: 1377 - RNA, 19 nt, Homo sapiens
guccucaccagccuccugg

SEQ ID NO: 1378 - RNA, 19 nt, Homo sapiens
uccucaccagccuccugga

SEQ ID NO: 1379 - RNA, 19 nt, Homo sapiens
cucaccagccuccuggaag

SEQ ID NO: 1380 - RNA, 19 nt, Homo sapiens
ucaccagccuccuggaagc

SEQ ID NO: 1381 - RNA, 19 nt, Homo sapiens
accagccuccuggaagccu

SEQ ID NO: 1382 - RNA, 19 nt, Homo sapiens
ccagccuccuggaagccuu

SEQ ID NO: 1383 - RNA, 19 nt, Homo sapiens
cagccuccuggaagccuuu

SEQ ID NO: 1384 - RNA, 19 nt, Homo sapiens
agccuccuggaagccuuug

SEQ ID NO: 1385 - RNA, 19 nt, Homo sapiens
gccuccuggaagccuuugc

SEQ ID NO: 1386 - RNA, 19 nt, Homo sapiens
ccuccuggaagccuuugcu

SEQ ID NO: 1387 - RNA, 19 nt, Homo sapiens
cuccuggaagccuuugcuc

SEQ ID NO: 1388 - RNA, 19 nt, Homo sapiens
uccuggaagccuuugcuca

SEQ ID NO: 1389 - RNA, 19 nt, Homo sapiens
ccuggaagccuuugcucac

SEQ ID NO: 1390 - RNA, 19 nt, Homo sapiens
cuggaagccuuugcucaca

SEQ ID NO: 1391 - RNA, 19 nt, Homo sapiens
ggaagccuuugcucacaca

SEQ ID NO: 1392 - RNA, 19 nt, Homo sapiens
gaagccuuugcucacacag

SEQ ID NO: 1393 - RNA, 19 nt, Homo sapiens
aagccuuugcucacacaga

SEQ ID NO: 1394 - RNA, 19 nt, Homo sapiens
agccuuugcucacacagac

SEQ ID NO: 1395 - RNA, 19 nt, Homo sapiens
gccuuugcucacacagacc

SEQ ID NO: 1396 - RNA, 19 nt, Homo sapiens
ccuuugcucacacagaccu

SEQ ID NO: 1397 - RNA, 19 nt, Homo sapiens
cuuugcucacacagaccuc

SEQ ID NO: 1398 - RNA, 19 nt, Homo sapiens
uuugcucacacagaccuca

SEQ ID NO: 1399 - RNA, 19 nt, Homo sapiens
ugcucacacagaccucagu

SEQ ID NO: 1400 - RNA, 19 nt, Homo sapiens
cucacacagaccucagugg

SEQ ID NO: 1401 - RNA, 19 nt, Homo sapiens
cacacagaccucaguggga

SEQ ID NO: 1402 - RNA, 19 nt, Homo sapiens
acacagaccucagugggaa

SEQ ID NO: 1403 - RNA, 19 nt, Homo sapiens
cacagaccucagugggaag

SEQ ID NO: 1404 - RNA, 19 nt, Homo sapiens
agaccucagugggaaggug

SEQ ID NO: 1405 - RNA, 19 nt, Homo sapiens
gaccucagugggaaggugu

SEQ ID NO: 1406 - RNA, 19 nt, Homo sapiens
accucagugggaagguguu

SEQ ID NO: 1407 - RNA, 19 nt, Homo sapiens
ccucagugggaagguguuu

SEQ ID NO: 1408 - RNA, 19 nt, Homo sapiens
cucagugggaagguguuug

SEQ ID NO: 1409 - RNA, 19 nt, Homo sapiens
ucagugggaagguguuugu

SEQ ID NO: 1410 - RNA, 19 nt, Homo sapiens
cagugggaagguguuugua

SEQ ID NO: 1411 - RNA, 19 nt, Homo sapiens
agugggaagguguuuguau

SEQ ID NO: 1412 - RNA, 19 nt, Homo sapiens
gugggaagguguuuguauu

SEQ ID NO: 1413 - RNA, 19 nt, Homo sapiens
ugggaagguguuuguauuu

SEQ ID NO: 1414 - RNA, 19 nt, Homo sapiens
gggaagguguuuguauuuc

SEQ ID NO: 1415 - RNA, 19 nt, Homo sapiens
ggaagguguuuguauuucc

SEQ ID NO: 1416 - RNA, 19 nt, Homo sapiens
gaagguguuuguauuuccu

SEQ ID NO: 1417 - RNA, 19 nt, Homo sapiens
aagguguuuguauuuccua

SEQ ID NO: 1418 - RNA, 19 nt, Homo sapiens
agguguuuguauuuccuag

SEQ ID NO: 1419 - RNA, 19 nt, Homo sapiens
gguguuuguauuuccuaga

SEQ ID NO: 1420 - RNA, 19 nt, Homo sapiens
guguuuguauuuccuagag

SEQ ID NO: 1421 - RNA, 19 nt, Homo sapiens
uguuuguauuuccuagaga

SEQ ID NO: 1422 - RNA, 19 nt, Homo sapiens
guuuguauuuccuagagaa

SEQ ID NO: 1423 - RNA, 19 nt, Homo sapiens
uuuguauuuccuagagaau

SEQ ID NO: 1424 - RNA, 19 nt, Homo sapiens
uuguauuuccuagagaauc

SEQ ID NO: 1425 - RNA, 19 nt, Homo sapiens
uguauuuccuagagaaucu

SEQ ID NO: 1426 - RNA, 19 nt, Homo sapiens
guauuuccuagagaaucug

SEQ ID NO: 1427 - RNA, 19 nt, Homo sapiens
uauuuccuagagaaucugu

SEQ ID NO: 1428 - RNA, 19 nt, Homo sapiens
auuuccuagagaaucuguu

SEQ ID NO: 1429 - RNA, 19 nt, Homo sapiens
uuuccuagagaaucuguua

SEQ ID NO: 1430 - RNA, 19 nt, Homo sapiens
uccuagagaaucuguuacu

SEQ ID NO: 1431 - RNA, 19 nt, Homo sapiens
ccuagagaaucuguuacug

SEQ ID NO: 1432 - RNA, 19 nt, Homo sapiens
cuagagaaucuguuacuga

SEQ ID NO: 1433 - RNA, 19 nt, Homo sapiens
uagagaaucuguuacugau

SEQ ID NO: 1434 - RNA, 19 nt, Homo sapiens
agagaaucuguuacugauc

SEQ ID NO: 1435 - RNA, 19 nt, Homo sapiens
gagaaucuguuacugauca

SEQ ID NO: 1436 - RNA, 19 nt, Homo sapiens
agaaucuguuacugaucau

SEQ ID NO: 1437 - RNA, 19 nt, Homo sapiens
gaaucuguuacugaucaug

SEQ ID NO: 1438 - RNA, 19 nt, Homo sapiens
aaucuguuacugaucaugu

SEQ ID NO: 1439 - RNA, 19 nt, Homo sapiens
aucuguuacugaucaugua

SEQ ID NO: 1440 - RNA, 19 nt, Homo sapiens
ucuguuacugaucauguaa

SEQ ID NO: 1441 - RNA, 19 nt, Homo sapiens
cuguuacugaucauguaaa

SEQ ID NO: 1442 - RNA, 19 nt, Homo sapiens
uguuacugaucauguaaac

SEQ ID NO: 1443 - RNA, 19 nt, Homo sapiens
guuacugaucauguaaacu

SEQ ID NO: 1444 - RNA, 19 nt, Homo sapiens
acugaucauguaaacuuga

SEQ ID NO: 1445 - RNA, 19 nt, Homo sapiens
cugaucauguaaacuugau

SEQ ID NO: 1446 - RNA, 19 nt, Homo sapiens
ugaucauguaaacuugauc

SEQ ID NO: 1447 - RNA, 19 nt, Homo sapiens
gaucauguaaacuugauca

SEQ ID NO: 1448 - RNA, 19 nt, Homo sapiens
ucauguaaacuugaucaca

SEQ ID NO: 1449 - RNA, 19 nt, Homo sapiens
cauguaaacuugaucacac

SEQ ID NO: 1450 - RNA, 19 nt, Homo sapiens
uaaacuugaucacaccgcu

SEQ ID NO: 1451 - RNA, 19 nt, Homo sapiens
aaacuugaucacaccgcug

SEQ ID NO: 1452 - RNA, 19 nt, Homo sapiens
acuugaucacaccgcugga

SEQ ID NO: 1453 - RNA, 19 nt, Homo sapiens
uugaucacaccgcuggaga

SEQ ID NO: 1454 - RNA, 19 nt, Homo sapiens
ugaucacaccgcuggagaa

SEQ ID NO: 1455 - RNA, 19 nt, Homo sapiens
gaucacaccgcuggagaag

SEQ ID NO: 1456 - RNA, 19 nt, Homo sapiens
cacaccgcuggagaagccu

SEQ ID NO: 1457 - RNA, 19 nt, Homo sapiens
acaccgcuggagaagccuc

SEQ ID NO: 1458 - RNA, 19 nt, Homo sapiens
caccgcuggagaagccucu

SEQ ID NO: 1459 - RNA, 19 nt, Homo sapiens
accgcuggagaagccucua

SEQ ID NO: 1460 - RNA, 19 nt, Homo sapiens
ccgcuggagaagccucuac

SEQ ID NO: 1461 - RNA, 19 nt, Homo sapiens
cgcuggagaagccucuaca

SEQ ID NO: 1462 - RNA, 19 nt, Homo sapiens
gcuggagaagccucuacag

SEQ ID NO: 1463 - RNA, 19 nt, Homo sapiens
cuggagaagccucuacaga

SEQ ID NO: 1464 - RNA, 19 nt, Homo sapiens
uggagaagccucuacagaa

SEQ ID NO: 1465 - RNA, 19 nt, Homo sapiens
ggagaagccucuacagaac

SEQ ID NO: 1466 - RNA, 19 nt, Homo sapiens
gagaagccucuacagaacu

SEQ ID NO: 1467 - RNA, 19 nt, Homo sapiens
agaagccucuacagaacuu

SEQ ID NO: 1468 - RNA, 19 nt, Homo sapiens
gaagccucuacagaacuuu

SEQ ID NO: 1469 - RNA, 19 nt, Homo sapiens
aagccucuacagaacuuua

SEQ ID NO: 1470 - RNA, 19 nt, Homo sapiens
agccucuacagaacuuuac

SEQ ID NO: 1471 - RNA, 19 nt, Homo sapiens
gccucuacagaacuuuacc

SEQ ID NO: 1472 - RNA, 19 nt, Homo sapiens
ccucuacagaacuuuaccu

SEQ ID NO: 1473 - RNA, 19 nt, Homo sapiens
cucuacagaacuuuaccuu

SEQ ID NO: 1474 - RNA, 19 nt, Homo sapiens
ucuacagaacuuuaccuug

SEQ ID NO: 1475 - RNA, 19 nt, Homo sapiens
cuacagaacuuuaccuugu

SEQ ID NO: 1476 - RNA, 19 nt, Homo sapiens
uacagaacuuuaccuugug

SEQ ID NO: 1477 - RNA, 19 nt, Homo sapiens
acagaacuuuaccuugugu

SEQ ID NO: 1478 - RNA, 19 nt, Homo sapiens
cagaacuuuaccuuguguu

SEQ ID NO: 1479 - RNA, 19 nt, Homo sapiens
agaacuuuaccuuguguuu

SEQ ID NO: 1480 - RNA, 19 nt, Homo sapiens
gaacuuuaccuuguguuuu

SEQ ID NO: 1481 - RNA, 19 nt, Homo sapiens
aacuuuaccuuguguuuuc

SEQ ID NO: 1482 - RNA, 19 nt, Homo sapiens
cuuuaccuuguguuuucga

SEQ ID NO: 1483 - RNA, 19 nt, Homo sapiens
accuuguguuuucgagccu

SEQ ID NO: 1484 - RNA, 19 nt, Homo sapiens
ccuuguguuuucgagccua

SEQ ID NO: 1485 - RNA, 19 nt, Homo sapiens
cuuguguuuucgagccuau

SEQ ID NO: 1486 - RNA, 19 nt, Homo sapiens
uuguguuuucgagccuaua

SEQ ID NO: 1487 - RNA, 19 nt, Homo sapiens
guguuuucgagccuauagu

SEQ ID NO: 1488 - RNA, 19 nt, Homo sapiens
guuuucgagccuauaguga

SEQ ID NO: 1489 - RNA, 19 nt, Homo sapiens
uuuucgagccuauagugau

SEQ ID NO: 1490 - RNA, 19 nt, Homo sapiens
cgagccuauagugaucucu

SEQ ID NO: 1491 - RNA, 19 nt, Homo sapiens
gagccuauagugaucucuc

SEQ ID NO: 1492 - RNA, 19 nt, Homo sapiens
agccuauagugaucucucu

SEQ ID NO: 1493 - RNA, 19 nt, Homo sapiens
gccuauagugaucucucuc

SEQ ID NO: 1494 - RNA, 19 nt, Homo sapiens
ccuauagugaucucucucg

SEQ ID NO: 1495 - RNA, 19 nt, Homo sapiens
cuauagugaucucucucgu

SEQ ID NO: 1496 - RNA, 19 nt, Homo sapiens
uauagugaucucucucgug

SEQ ID NO: 1497 - RNA, 19 nt, Homo sapiens
agugaucucucucgugccu

SEQ ID NO: 1498 - RNA, 19 nt, Homo sapiens
gugaucucucucgugccua

SEQ ID NO: 1499 - RNA, 19 nt, Homo sapiens
ugaucucucucgugccuac

SEQ ID NO: 1500 - RNA, 19 nt, Homo sapiens
gaucucucucgugccuaca

SEQ ID NO: 1501 - RNA, 19 nt, Homo sapiens
cucucgugccuacagccuc

SEQ ID NO: 1502 - RNA, 19 nt, Homo sapiens
ucucgugccuacagccucu

SEQ ID NO: 1503 - RNA, 19 nt, Homo sapiens
cucgugccuacagccucuu

SEQ ID NO: 1504 - RNA, 19 nt, Homo sapiens
cgugccuacagccucuucu

SEQ ID NO: 1505 - RNA, 19 nt, Homo sapiens
gugccuacagccucuucuc

SEQ ID NO: 1506 - RNA, 19 nt, Homo sapiens
gccuacagccucuucuccu

SEQ ID NO: 1507 - RNA, 19 nt, Homo sapiens
ccuacagccucuucuccua

SEQ ID NO: 1508 - RNA, 19 nt, Homo sapiens
cuacagccucuucuccuac

SEQ ID NO: 1509 - RNA, 19 nt, Homo sapiens
uacagccucuucuccuaca

SEQ ID NO: 1510 - RNA, 19 nt, Homo sapiens
acagccucuucuccuacaa

SEQ ID NO: 1511 - RNA, 19 nt, Homo sapiens
cagccucuucuccuacaau

SEQ ID NO: 1512 - RNA, 19 nt, Homo sapiens
agccucuucuccuacaaua

SEQ ID NO: 1513 - RNA, 19 nt, Homo sapiens
gccucuucuccuacaauac

SEQ ID NO: 1514 - RNA, 19 nt, Homo sapiens
ccucuucuccuacaauacc

SEQ ID NO: 1515 - RNA, 19 nt, Homo sapiens
ucuucuccuacaauaccca

SEQ ID NO: 1516 - RNA, 19 nt, Homo sapiens
ucuccuacaauacccaagg

SEQ ID NO: 1517 - RNA, 19 nt, Homo sapiens
cuccuacaauacccaaggc

SEQ ID NO: 1518 - RNA, 19 nt, Homo sapiens
uccuacaauacccaaggca

SEQ ID NO: 1519 - RNA, 19 nt, Homo sapiens
ccuacaauacccaaggcag

SEQ ID NO: 1520 - RNA, 19 nt, Homo sapiens
cuacaauacccaaggcagg

SEQ ID NO: 1521 - RNA, 19 nt, Homo sapiens
caauacccaaggcagggau

SEQ ID NO: 1522 - RNA, 19 nt, Homo sapiens
auacccaaggcagggauaa

SEQ ID NO: 1523 - RNA, 19 nt, Homo sapiens
uacccaaggcagggauaau

SEQ ID NO: 1524 - RNA, 19 nt, Homo sapiens
ccaaggcagggauaaugag

SEQ ID NO: 1525 - RNA, 19 nt, Homo sapiens
aaggcagggauaaugagcu

SEQ ID NO: 1526 - RNA, 19 nt, Homo sapiens
aggcagggauaaugagcua

SEQ ID NO: 1527 - RNA, 19 nt, Homo sapiens
gcagggauaaugagcuacu

SEQ ID NO: 1528 - RNA, 19 nt, Homo sapiens
cagggauaaugagcuacua

SEQ ID NO: 1529 - RNA, 19 nt, Homo sapiens
agggauaaugagcuacuag

SEQ ID NO: 1530 - RNA, 19 nt, Homo sapiens
gggauaaugagcuacuagu

SEQ ID NO: 1531 - RNA, 19 nt, Homo sapiens
ggauaaugagcuacuaguu

SEQ ID NO: 1532 - RNA, 19 nt, Homo sapiens
gauaaugagcuacuaguuu

SEQ ID NO: 1533 - RNA, 19 nt, Homo sapiens
auaaugagcuacuaguuua

SEQ ID NO: 1534 - RNA, 19 nt, Homo sapiens
uaaugagcuacuaguuuau

SEQ ID NO: 1535 - RNA, 19 nt, Homo sapiens
augagcuacuaguuuauaa

SEQ ID NO: 1536 - RNA, 19 nt, Homo sapiens
ugagcuacuaguuuauaaa

SEQ ID NO: 1537 - RNA, 19 nt, Homo sapiens
gagcuacuaguuuauaaag

SEQ ID NO: 1538 - RNA, 19 nt, Homo sapiens
agcuacuaguuuauaaaga

SEQ ID NO: 1539 - RNA, 19 nt, Homo sapiens
gcuacuaguuuauaaagaa

SEQ ID NO: 1540 - RNA, 19 nt, Homo sapiens
cuacuaguuuauaaagaaa

SEQ ID NO: 1541 - RNA, 19 nt, Homo sapiens
aguuuauaaagaaagaguu

SEQ ID NO: 1542 - RNA, 19 nt, Homo sapiens
aagaaagaguuggagagua

SEQ ID NO: 1543 - RNA, 19 nt, Homo sapiens
agaaagaguuggagaguau

SEQ ID NO: 1544 - RNA, 19 nt, Homo sapiens
gaaagaguuggagaguaua

SEQ ID NO: 1545 - RNA, 19 nt, Homo sapiens
aagaguuggagaguauagu

SEQ ID NO: 1546 - RNA, 19 nt, Homo sapiens
agaguuggagaguauaguc

SEQ ID NO: 1547 - RNA, 19 nt, Homo sapiens
gaguuggagaguauagucu

SEQ ID NO: 1548 - RNA, 19 nt, Homo sapiens
aguuggagaguauagucua

SEQ ID NO: 1549 - RNA, 19 nt, Homo sapiens
guuggagaguauagucuau

SEQ ID NO: 1550 - RNA, 19 nt, Homo sapiens
uuggagaguauagucuaua

SEQ ID NO: 1551 - RNA, 19 nt, Homo sapiens
uggagaguauagucuauac

SEQ ID NO: 1552 - RNA, 19 nt, Homo sapiens
ggagaguauagucuauaca

SEQ ID NO: 1553 - RNA, 19 nt, Homo sapiens
gagaguauagucuauacau

SEQ ID NO: 1554 - RNA, 19 nt, Homo sapiens
agaguauagucuauacauu

SEQ ID NO: 1555 - RNA, 19 nt, Homo sapiens
gaguauagucuauacauug

SEQ ID NO: 1556 - RNA, 19 nt, Homo sapiens
aguauagucuauacauugg

SEQ ID NO: 1557 - RNA, 19 nt, Homo sapiens
guauagucuauacauugga

SEQ ID NO: 1558 - RNA, 19 nt, Homo sapiens
gucuauacauuggaagaca

SEQ ID NO: 1559 - RNA, 19 nt, Homo sapiens
cuauacauuggaagacaca

SEQ ID NO: 1560 - RNA, 19 nt, Homo sapiens
uauacauuggaagacacaa

SEQ ID NO: 1561 - RNA, 19 nt, Homo sapiens
auacauuggaagacacaaa

SEQ ID NO: 1562 - RNA, 19 nt, Homo sapiens
acauuggaagacacaaagu

SEQ ID NO: 1563 - RNA, 19 nt, Homo sapiens
cauuggaagacacaaaguu

SEQ ID NO: 1564 - RNA, 19 nt, Homo sapiens
auuggaagacacaaaguua

SEQ ID NO: 1565 - RNA, 19 nt, Homo sapiens
uggaagacacaaaguuaca

SEQ ID NO: 1566 - RNA, 19 nt, Homo sapiens
ggaagacacaaaguuacau

SEQ ID NO: 1567 - RNA, 19 nt, Homo sapiens
gaagacacaaaguuacauc

SEQ ID NO: 1568 - RNA, 19 nt, Homo sapiens
aagacacaaaguuacaucc

SEQ ID NO: 1569 - RNA, 19 nt, Homo sapiens
agacacaaaguuacaucca

SEQ ID NO: 1570 - RNA, 19 nt, Homo sapiens
gacacaaaguuacauccaa

SEQ ID NO: 1571 - RNA, 19 nt, Homo sapiens
acacaaaguuacauccaaa

SEQ ID NO: 1572 - RNA, 19 nt, Homo sapiens
cacaaaguuacauccaaag

SEQ ID NO: 1573 - RNA, 19 nt, Homo sapiens
caaaguuacauccaaaguu

SEQ ID NO: 1574 - RNA, 19 nt, Homo sapiens
aaaguuacauccaaaguua

SEQ ID NO: 1575 - RNA, 19 nt, Homo sapiens
aaguuacauccaaaguuau

SEQ ID NO: 1576 - RNA, 19 nt, Homo sapiens
aguuacauccaaaguuauc

SEQ ID NO: 1577 - RNA, 19 nt, Homo sapiens
guuacauccaaaguuaucg

SEQ ID NO: 1578 - RNA, 19 nt, Homo sapiens
uuacauccaaaguuaucga

SEQ ID NO: 1579 - RNA, 19 nt, Homo sapiens
uacauccaaaguuaucgaa

SEQ ID NO: 1580 - RNA, 19 nt, Homo sapiens
acauccaaaguuaucgaaa

SEQ ID NO: 1581 - RNA, 19 nt, Homo sapiens
cauccaaaguuaucgaaaa

SEQ ID NO: 1582 - RNA, 19 nt, Homo sapiens
auccaaaguuaucgaaaag

SEQ ID NO: 1583 - RNA, 19 nt, Homo sapiens
uccaaaguuaucgaaaagu

SEQ ID NO: 1584 - RNA, 19 nt, Homo sapiens
ccaaaguuaucgaaaaguu

SEQ ID NO: 1585 - RNA, 19 nt, Homo sapiens
caaaguuaucgaaaaguuc

SEQ ID NO: 1586 - RNA, 19 nt, Homo sapiens
cgaaaaguucccggcucca

SEQ ID NO: 1587 - RNA, 19 nt, Homo sapiens
aaaaguucccggcuccagu

SEQ ID NO: 1588 - RNA, 19 nt, Homo sapiens
cccggcuccagugcacauc

SEQ ID NO: 1589 - RNA, 19 nt, Homo sapiens
cggcuccagugcacaucug

SEQ ID NO: 1590 - RNA, 19 nt, Homo sapiens
ggcuccagugcacaucugu

SEQ ID NO: 1591 - RNA, 19 nt, Homo sapiens
gcuccagugcacaucugug

SEQ ID NO: 1592 - RNA, 19 nt, Homo sapiens
cuccagugcacaucugugu

SEQ ID NO: 1593 - RNA, 19 nt, Homo sapiens
ccagugcacaucuguguga

SEQ ID NO: 1594 - RNA, 19 nt, Homo sapiens
gugcacaucugugugagcu

SEQ ID NO: 1595 - RNA, 19 nt, Homo sapiens
gcacaucugugugagcugg

SEQ ID NO: 1596 - RNA, 19 nt, Homo sapiens
acaucugugugagcuggga

SEQ ID NO: 1597 - RNA, 19 nt, Homo sapiens
aucugugugagcugggagu

SEQ ID NO: 1598 - RNA, 19 nt, Homo sapiens
ugugugagcugggaguccu

SEQ ID NO: 1599 - RNA, 19 nt, Homo sapiens
gugugagcugggaguccuc

SEQ ID NO: 1600 - RNA, 19 nt, Homo sapiens
agcugggaguccucaucag

SEQ ID NO: 1601 - RNA, 19 nt, Homo sapiens
gcugggaguccucaucagg

SEQ ID NO: 1602 - RNA, 19 nt, Homo sapiens
cugggaguccucaucaggu

SEQ ID NO: 1603 - RNA, 19 nt, Homo sapiens
ugggaguccucaucaggua

SEQ ID NO: 1604 - RNA, 19 nt, Homo sapiens
gggaguccucaucagguau

SEQ ID NO: 1605 - RNA, 19 nt, Homo sapiens
ggaguccucaucagguauu

SEQ ID NO: 1606 - RNA, 19 nt, Homo sapiens
gaguccucaucagguauug

SEQ ID NO: 1607 - RNA, 19 nt, Homo sapiens
guccucaucagguauugcu

SEQ ID NO: 1608 - RNA, 19 nt, Homo sapiens
uccucaucagguauugcug

SEQ ID NO: 1609 - RNA, 19 nt, Homo sapiens
ccucaucagguauugcuga

SEQ ID NO: 1610 - RNA, 19 nt, Homo sapiens
cucaucagguauugcugaa

SEQ ID NO: 1611 - RNA, 19 nt, Homo sapiens
ucaucagguauugcugaau

SEQ ID NO: 1612 - RNA, 19 nt, Homo sapiens
caucagguauugcugaauu

SEQ ID NO: 1613 - RNA, 19 nt, Homo sapiens
aucagguauugcugaauuu

SEQ ID NO: 1614 - RNA, 19 nt, Homo sapiens
ucagguauugcugaauuuu

SEQ ID NO: 1615 - RNA, 19 nt, Homo sapiens
cagguauugcugaauuuug

SEQ ID NO: 1616 - RNA, 19 nt, Homo sapiens
agguauugcugaauuuugg

SEQ ID NO: 1617 - RNA, 19 nt, Homo sapiens
gguauugcugaauuuugga

SEQ ID NO: 1618 - RNA, 19 nt, Homo sapiens
guauugcugaauuuuggau

SEQ ID NO: 1619 - RNA, 19 nt, Homo sapiens
auugcugaauuuuggauca

SEQ ID NO: 1620 - RNA, 19 nt, Homo sapiens
ugcugaauuuuggaucaau

SEQ ID NO: 1621 - RNA, 19 nt, Homo sapiens
gcugaauuuuggaucaaug

SEQ ID NO: 1622 - RNA, 19 nt, Homo sapiens
cugaauuuuggaucaaugg

SEQ ID NO: 1623 - RNA, 19 nt, Homo sapiens
gaauuuuggaucaauggga

SEQ ID NO: 1624 - RNA, 19 nt, Homo sapiens
ggaucaaugggacaccuuu

SEQ ID NO: 1625 - RNA, 19 nt, Homo sapiens
caaugggacaccuuuggug

SEQ ID NO: 1626 - RNA, 19 nt, Homo sapiens
aaugggacaccuuugguga

SEQ ID NO: 1627 - RNA, 19 nt, Homo sapiens
augggacaccuuuggugaa

SEQ ID NO: 1628 - RNA, 19 nt, Homo sapiens
ugggacaccuuuggugaaa

SEQ ID NO: 1629 - RNA, 19 nt, Homo sapiens
gggacaccuuuggugaaaa

SEQ ID NO: 1630 - RNA, 19 nt, Homo sapiens
ggacaccuuuggugaaaaa

SEQ ID NO: 1631 - RNA, 19 nt, Homo sapiens
accuuuggugaaaaagggu

SEQ ID NO: 1632 - RNA, 19 nt, Homo sapiens
ccuuuggugaaaaaggguc

SEQ ID NO: 1633 - RNA, 19 nt, Homo sapiens
cuuuggugaaaaagggucu

SEQ ID NO: 1634 - RNA, 19 nt, Homo sapiens
ggugaaaaagggucugcga

SEQ ID NO: 1635 - RNA, 19 nt, Homo sapiens
gugaaaaagggucugcgac

SEQ ID NO: 1636 - RNA, 19 nt, Homo sapiens
ugaaaaagggucugcgaca

SEQ ID NO: 1637 - RNA, 19 nt, Homo sapiens
gaaaaagggucugcgacag

SEQ ID NO: 1638 - RNA, 19 nt, Homo sapiens
aaagggucugcgacagggu

SEQ ID NO: 1639 - RNA, 19 nt, Homo sapiens
aagggucugcgacaggguu

SEQ ID NO: 1640 - RNA, 19 nt, Homo sapiens
agggucugcgacaggguua

SEQ ID NO: 1641 - RNA, 19 nt, Homo sapiens
gggucugcgacaggguuac

SEQ ID NO: 1642 - RNA, 19 nt, Homo sapiens
ggucugcgacaggguuacu

SEQ ID NO: 1643 - RNA, 19 nt, Homo sapiens
gucugcgacaggguuacuu

SEQ ID NO: 1644 - RNA, 19 nt, Homo sapiens
ucugcgacaggguuacuuu

SEQ ID NO: 1645 - RNA, 19 nt, Homo sapiens
cugcgacaggguuacuuug

SEQ ID NO: 1646 - RNA, 19 nt, Homo sapiens
ugcgacaggguuacuuugu

SEQ ID NO: 1647 - RNA, 19 nt, Homo sapiens
gcgacaggguuacuuugua

SEQ ID NO: 1648 - RNA, 19 nt, Homo sapiens
cgacaggguuacuuuguag

SEQ ID NO: 1649 - RNA, 19 nt, Homo sapiens
gacaggguuacuuuguaga

SEQ ID NO: 1650 - RNA, 19 nt, Homo sapiens
acaggguuacuuuguagaa

SEQ ID NO: 1651 - RNA, 19 nt, Homo sapiens
caggguuacuuuguagaag

SEQ ID NO: 1652 - RNA, 19 nt, Homo sapiens
aggguuacuuuguagaagc

SEQ ID NO: 1653 - RNA, 19 nt, Homo sapiens
ggguuacuuuguagaagcu

SEQ ID NO: 1654 - RNA, 19 nt, Homo sapiens
gguuacuuuguagaagcuc

SEQ ID NO: 1655 - RNA, 19 nt, Homo sapiens
guuacuuuguagaagcuca

SEQ ID NO: 1656 - RNA, 19 nt, Homo sapiens
agaagcucagcccaagauu

SEQ ID NO: 1657 - RNA, 19 nt, Homo sapiens
gaagcucagcccaagauug

SEQ ID NO: 1658 - RNA, 19 nt, Homo sapiens
aagcucagcccaagauugu

SEQ ID NO: 1659 - RNA, 19 nt, Homo sapiens
agcucagcccaagauuguc

SEQ ID NO: 1660 - RNA, 19 nt, Homo sapiens
cucagcccaagauuguccu

SEQ ID NO: 1661 - RNA, 19 nt, Homo sapiens
agcccaagauuguccuggg

SEQ ID NO: 1662 - RNA, 19 nt, Homo sapiens
ccaagauuguccuggggca

SEQ ID NO: 1663 - RNA, 19 nt, Homo sapiens
caagauuguccuggggcag

SEQ ID NO: 1664 - RNA, 19 nt, Homo sapiens
agauuguccuggggcagga

SEQ ID NO: 1665 - RNA, 19 nt, Homo sapiens
gauuguccuggggcaggaa

SEQ ID NO: 1666 - RNA, 19 nt, Homo sapiens
uuguccuggggcaggaaca

SEQ ID NO: 1667 - RNA, 19 nt, Homo sapiens
uccuggggcaggaacagga

SEQ ID NO: 1668 - RNA, 19 nt, Homo sapiens
cuggggcaggaacaggauu

SEQ ID NO: 1669 - RNA, 19 nt, Homo sapiens
uggggcaggaacaggauuc

SEQ ID NO: 1670 - RNA, 19 nt, Homo sapiens
ggggcaggaacaggauucc

SEQ ID NO: 1671 - RNA, 19 nt, Homo sapiens
ggcaggaacaggauuccua

SEQ ID NO: 1672 - RNA, 19 nt, Homo sapiens
gcaggaacaggauuccuau

SEQ ID NO: 1673 - RNA, 19 nt, Homo sapiens
caggaacaggauuccuaug

SEQ ID NO: 1674 - RNA, 19 nt, Homo sapiens
ggaacaggauuccuauggg

SEQ ID NO: 1675 - RNA, 19 nt, Homo sapiens
gaacaggauuccuaugggg

SEQ ID NO: 1676 - RNA, 19 nt, Homo sapiens
acaggauuccuaugggggc

SEQ ID NO: 1677 - RNA, 19 nt, Homo sapiens
caggauuccuaugggggca

SEQ ID NO: 1678 - RNA, 19 nt, Homo sapiens
ggauuccuaugggggcaag

SEQ ID NO: 1679 - RNA, 19 nt, Homo sapiens
gauuccuaugggggcaagu

SEQ ID NO: 1680 - RNA, 19 nt, Homo sapiens
auuccuaugggggcaaguu

SEQ ID NO: 1681 - RNA, 19 nt, Homo sapiens
uuccuaugggggcaaguuu

SEQ ID NO: 1682 - RNA, 19 nt, Homo sapiens
uccuaugggggcaaguuug

SEQ ID NO: 1683 - RNA, 19 nt, Homo sapiens
ccuaugggggcaaguuuga

SEQ ID NO: 1684 - RNA, 19 nt, Homo sapiens
cuaugggggcaaguuugau

SEQ ID NO: 1685 - RNA, 19 nt, Homo sapiens
uaugggggcaaguuugaua

SEQ ID NO: 1686 - RNA, 19 nt, Homo sapiens
gggggcaaguuugauagga

SEQ ID NO: 1687 - RNA, 19 nt, Homo sapiens
ggggcaaguuugauaggag

SEQ ID NO: 1688 - RNA, 19 nt, Homo sapiens
gggcaaguuugauaggagc

SEQ ID NO: 1689 - RNA, 19 nt, Homo sapiens
ggcaaguuugauaggagcc

SEQ ID NO: 1690 - RNA, 19 nt, Homo sapiens
gcaaguuugauaggagcca

SEQ ID NO: 1691 - RNA, 19 nt, Homo sapiens
caaguuugauaggagccag

SEQ ID NO: 1692 - RNA, 19 nt, Homo sapiens
aaguuugauaggagccagu

SEQ ID NO: 1693 - RNA, 19 nt, Homo sapiens
uugauaggagccaguccuu

SEQ ID NO: 1694 - RNA, 19 nt, Homo sapiens
ugauaggagccaguccuuu

SEQ ID NO: 1695 - RNA, 19 nt, Homo sapiens
gauaggagccaguccuuug

SEQ ID NO: 1696 - RNA, 19 nt, Homo sapiens
auaggagccaguccuuugu

SEQ ID NO: 1697 - RNA, 19 nt, Homo sapiens
aggagccaguccuuugugg

SEQ ID NO: 1698 - RNA, 19 nt, Homo sapiens
ggagccaguccuuuguggg

SEQ ID NO: 1699 - RNA, 19 nt, Homo sapiens
gagccaguccuuuguggga

SEQ ID NO: 1700 - RNA, 19 nt, Homo sapiens
agccaguccuuugugggag

SEQ ID NO: 1701 - RNA, 19 nt, Homo sapiens
gccaguccuuugugggaga

SEQ ID NO: 1702 - RNA, 19 nt, Homo sapiens
ccaguccuuugugggagag

SEQ ID NO: 1703 - RNA, 19 nt, Homo sapiens
caguccuuugugggagaga

SEQ ID NO: 1704 - RNA, 19 nt, Homo sapiens
aguccuuugugggagagau

SEQ ID NO: 1705 - RNA, 19 nt, Homo sapiens
guccuuugugggagagauu

SEQ ID NO: 1706 - RNA, 19 nt, Homo sapiens
uccuuugugggagagauug

SEQ ID NO: 1707 - RNA, 19 nt, Homo sapiens
ccuuugugggagagauugg

SEQ ID NO: 1708 - RNA, 19 nt, Homo sapiens
cuuugugggagagauuggg

SEQ ID NO: 1709 - RNA, 19 nt, Homo sapiens
uugugggagagauugggga

SEQ ID NO: 1710 - RNA, 19 nt, Homo sapiens
ugugggagagauuggggau

SEQ ID NO: 1711 - RNA, 19 nt, Homo sapiens
gugggagagauuggggauu

SEQ ID NO: 1712 - RNA, 19 nt, Homo sapiens
ugggagagauuggggauuu

SEQ ID NO: 1713 - RNA, 19 nt, Homo sapiens
gggagagauuggggauuug

SEQ ID NO: 1714 - RNA, 19 nt, Homo sapiens
ggagagauuggggauuugu

SEQ ID NO: 1715 - RNA, 19 nt, Homo sapiens
gagagauuggggauuugua

SEQ ID NO: 1716 - RNA, 19 nt, Homo sapiens
agagauuggggauuuguac

SEQ ID NO: 1717 - RNA, 19 nt, Homo sapiens
gagauuggggauuuguaca

SEQ ID NO: 1718 - RNA, 19 nt, Homo sapiens
agauuggggauuuguacau

SEQ ID NO: 1719 - RNA, 19 nt, Homo sapiens
ggggauuuguacauguggg

SEQ ID NO: 1720 - RNA, 19 nt, Homo sapiens
gggauuuguacauguggga

SEQ ID NO: 1721 - RNA, 19 nt, Homo sapiens
ggauuuguacaugugggac

SEQ ID NO: 1722 - RNA, 19 nt, Homo sapiens
gauuuguacaugugggacu

SEQ ID NO: 1723 - RNA, 19 nt, Homo sapiens
uguacaugugggacucugu

SEQ ID NO: 1724 - RNA, 19 nt, Homo sapiens
guacaugugggacucugug

SEQ ID NO: 1725 - RNA, 19 nt, Homo sapiens
acaugugggacucugugcu

SEQ ID NO: 1726 - RNA, 19 nt, Homo sapiens
gggacucugugcugccccc

SEQ ID NO: 1727 - RNA, 19 nt, Homo sapiens
ggacucugugcugccccca

SEQ ID NO: 1728 - RNA, 19 nt, Homo sapiens
acucugugcugcccccaga

SEQ ID NO: 1729 - RNA, 19 nt, Homo sapiens
cucugugcugcccccagaa

SEQ ID NO: 1730 - RNA, 19 nt, Homo sapiens
cugugcugcccccagaaaa

SEQ ID NO: 1731 - RNA, 19 nt, Homo sapiens
ugugcugcccccagaaaau

SEQ ID NO: 1732 - RNA, 19 nt, Homo sapiens
gugcugcccccagaaaaua

SEQ ID NO: 1733 - RNA, 19 nt, Homo sapiens
gcugcccccagaaaauauc

SEQ ID NO: 1734 - RNA, 19 nt, Homo sapiens
cccccagaaaauauccugu

SEQ ID NO: 1735 - RNA, 19 nt, Homo sapiens
cccagaaaauauccugucu

SEQ ID NO: 1736 - RNA, 19 nt, Homo sapiens
ccagaaaauauccugucug

SEQ ID NO: 1737 - RNA, 19 nt, Homo sapiens
cagaaaauauccugucugc

SEQ ID NO: 1738 - RNA, 19 nt, Homo sapiens
gaaaauauccugucugccu

SEQ ID NO: 1739 - RNA, 19 nt, Homo sapiens
aaaauauccugucugccua

SEQ ID NO: 1740 - RNA, 19 nt, Homo sapiens
aaauauccugucugccuau

SEQ ID NO: 1741 - RNA, 19 nt, Homo sapiens
ccugucugccuaucagggu

SEQ ID NO: 1742 - RNA, 19 nt, Homo sapiens
cugucugccuaucagggua

SEQ ID NO: 1743 - RNA, 19 nt, Homo sapiens
gucugccuaucaggguacc

SEQ ID NO: 1744 - RNA, 19 nt, Homo sapiens
ugccuaucaggguaccccu

SEQ ID NO: 1745 - RNA, 19 nt, Homo sapiens
gccuaucaggguaccccuc

SEQ ID NO: 1746 - RNA, 19 nt, Homo sapiens
ccuaucaggguaccccucu

SEQ ID NO: 1747 - RNA, 19 nt, Homo sapiens
cuaucaggguaccccucuc

SEQ ID NO: 1748 - RNA, 19 nt, Homo sapiens
caggguaccccucucccug

SEQ ID NO: 1749 - RNA, 19 nt, Homo sapiens
ggguaccccucucccugcc

SEQ ID NO: 1750 - RNA, 19 nt, Homo sapiens
gguaccccucucccugcca

SEQ ID NO: 1751 - RNA, 19 nt, Homo sapiens
guaccccucucccugccaa

SEQ ID NO: 1752 - RNA, 19 nt, Homo sapiens
uaccccucucccugccaau

SEQ ID NO: 1753 - RNA, 19 nt, Homo sapiens
ccccucucccugccaauau

SEQ ID NO: 1754 - RNA, 19 nt, Homo sapiens
cccucucccugccaauauc

SEQ ID NO: 1755 - RNA, 19 nt, Homo sapiens
cugccaauauccuggacug

SEQ ID NO: 1756 - RNA, 19 nt, Homo sapiens
ccaauauccuggacuggca

SEQ ID NO: 1757 - RNA, 19 nt, Homo sapiens
caauauccuggacuggcag

SEQ ID NO: 1758 - RNA, 19 nt, Homo sapiens
uccuggacuggcaggcucu

SEQ ID NO: 1759 - RNA, 19 nt, Homo sapiens
ccuggacuggcaggcucug

SEQ ID NO: 1760 - RNA, 19 nt, Homo sapiens
cuggacuggcaggcucuga

SEQ ID NO: 1761 - RNA, 19 nt, Homo sapiens
uggacuggcaggcucugaa

SEQ ID NO: 1762 - RNA, 19 nt, Homo sapiens
ggacuggcaggcucugaac

SEQ ID NO: 1763 - RNA, 19 nt, Homo sapiens
gacuggcaggcucugaacu

SEQ ID NO: 1764 - RNA, 19 nt, Homo sapiens
acuggcaggcucugaacua

SEQ ID NO: 1765 - RNA, 19 nt, Homo sapiens
cuggcaggcucugaacuau

SEQ ID NO: 1766 - RNA, 19 nt, Homo sapiens
uggcaggcucugaacuaug

SEQ ID NO: 1767 - RNA, 19 nt, Homo sapiens
ggcaggcucugaacuauga

SEQ ID NO: 1768 - RNA, 19 nt, Homo sapiens
gcaggcucugaacuaugaa

SEQ ID NO: 1769 - RNA, 19 nt, Homo sapiens
caggcucugaacuaugaaa

SEQ ID NO: 1770 - RNA, 19 nt, Homo sapiens
aggcucugaacuaugaaau

SEQ ID NO: 1771 - RNA, 19 nt, Homo sapiens
ggcucugaacuaugaaauc

SEQ ID NO: 1772 - RNA, 19 nt, Homo sapiens
gcucugaacuaugaaauca

SEQ ID NO: 1773 - RNA, 19 nt, Homo sapiens
cucugaacuaugaaaucag

SEQ ID NO: 1774 - RNA, 19 nt, Homo sapiens
ucugaacuaugaaaucaga

SEQ ID NO: 1775 - RNA, 19 nt, Homo sapiens
gaacuaugaaaucagagga

SEQ ID NO: 1776 - RNA, 19 nt, Homo sapiens
aacuaugaaaucagaggau

SEQ ID NO: 1777 - RNA, 19 nt, Homo sapiens
acuaugaaaucagaggaua

SEQ ID NO: 1778 - RNA, 19 nt, Homo sapiens
cuaugaaaucagaggauau

SEQ ID NO: 1779 - RNA, 19 nt, Homo sapiens
uaugaaaucagaggauaug

SEQ ID NO: 1780 - RNA, 19 nt, Homo sapiens
ugaaaucagaggauauguc

SEQ ID NO: 1781 - RNA, 19 nt, Homo sapiens
gaaaucagaggauauguca

SEQ ID NO: 1782 - RNA, 19 nt, Homo sapiens
aaaucagaggauaugucau

SEQ ID NO: 1783 - RNA, 19 nt, Homo sapiens
aaucagaggauaugucauc

SEQ ID NO: 1784 - RNA, 19 nt, Homo sapiens
cagaggauaugucaucauc

SEQ ID NO: 1785 - RNA, 19 nt, Homo sapiens
agaggauaugucaucauca

SEQ ID NO: 1786 - RNA, 19 nt, Homo sapiens
gaggauaugucaucaucaa

SEQ ID NO: 1787 - RNA, 19 nt, Homo sapiens
aggauaugucaucaucaaa

SEQ ID NO: 1788 - RNA, 19 nt, Homo sapiens
ggauaugucaucaucaaac

SEQ ID NO: 1789 - RNA, 19 nt, Homo sapiens
gauaugucaucaucaaacc

SEQ ID NO: 1790 - RNA, 19 nt, Homo sapiens
augucaucaucaaacccuu

SEQ ID NO: 1791 - RNA, 19 nt, Homo sapiens
caucaucaaacccuuggug

SEQ ID NO: 1792 - RNA, 19 nt, Homo sapiens
ucaucaaacccuuggugug

SEQ ID NO: 1793 - RNA, 19 nt, Homo sapiens
acccuuggugugggucuga

SEQ ID NO: 1794 - RNA, 19 nt, Homo sapiens
cccuuggugugggucugag

SEQ ID NO: 1795 - RNA, 19 nt, Homo sapiens
ccuuggugugggucugagg

SEQ ID NO: 1796 - RNA, 19 nt, Homo sapiens
cuuggugugggucugaggu

SEQ ID NO: 1797 - RNA, 19 nt, Homo sapiens
uggugugggucugaggucu

SEQ ID NO: 1798 - RNA, 19 nt, Homo sapiens
ggugugggucugaggucuu

SEQ ID NO: 1799 - RNA, 19 nt, Homo sapiens
gugugggucugaggucuug

SEQ ID NO: 1800 - RNA, 19 nt, Homo sapiens
ugugggucugaggucuuga

SEQ ID NO: 1801 - RNA, 19 nt, Homo sapiens
gugggucugaggucuugac

SEQ ID NO: 1802 - RNA, 19 nt, Homo sapiens
gggucugaggucuugacuc

SEQ ID NO: 1803 - RNA, 19 nt, Homo sapiens
ggucugaggucuugacuca

SEQ ID NO: 1804 - RNA, 19 nt, Homo sapiens
gucugaggucuugacucaa

SEQ ID NO: 1805 - RNA, 19 nt, Homo sapiens
cugaggucuugacucaacg

SEQ ID NO: 1806 - RNA, 19 nt, Homo sapiens
ugaggucuugacucaacga

SEQ ID NO: 1807 - RNA, 19 nt, Homo sapiens
gaggucuugacucaacgag

SEQ ID NO: 1808 - RNA, 19 nt, Homo sapiens
aggucuugacucaacgaga

SEQ ID NO: 1809 - RNA, 19 nt, Homo sapiens
ggucuugacucaacgagag

SEQ ID NO: 1810 - RNA, 19 nt, Homo sapiens
gucuugacucaacgagagc

SEQ ID NO: 1811 - RNA, 19 nt, Homo sapiens
ucuugacucaacgagagca

SEQ ID NO: 1812 - RNA, 19 nt, Homo sapiens
cuugacucaacgagagcac

SEQ ID NO: 1813 - RNA, 19 nt, Homo sapiens
uugacucaacgagagcacu

SEQ ID NO: 1814 - RNA, 19 nt, Homo sapiens
ugacucaacgagagcacuu

SEQ ID NO: 1815 - RNA, 19 nt, Homo sapiens
gacucaacgagagcacuug

SEQ ID NO: 1816 - RNA, 19 nt, Homo sapiens
acucaacgagagcacuuga

SEQ ID NO: 1817 - RNA, 19 nt, Homo sapiens
cucaacgagagcacuugaa

SEQ ID NO: 1818 - RNA, 19 nt, Homo sapiens
ucaacgagagcacuugaaa

SEQ ID NO: 1819 - RNA, 19 nt, Homo sapiens
caacgagagcacuugaaaa

SEQ ID NO: 1820 - RNA, 19 nt, Homo sapiens
aacgagagcacuugaaaau

SEQ ID NO: 1821 - RNA, 19 nt, Homo sapiens
acgagagcacuugaaaaug

SEQ ID NO: 1822 - RNA, 19 nt, Homo sapiens
cgagagcacuugaaaauga

SEQ ID NO: 1823 - RNA, 19 nt, Homo sapiens
gagagcacuugaaaaugaa

SEQ ID NO: 1824 - RNA, 19 nt, Homo sapiens
agagcacuugaaaaugaaa

SEQ ID NO: 1825 - RNA, 19 nt, Homo sapiens
gagcacuugaaaaugaaau

SEQ ID NO: 1826 - RNA, 19 nt, Homo sapiens
agcacuugaaaaugaaaug

SEQ ID NO: 1827 - RNA, 19 nt, Homo sapiens
gcacuugaaaaugaaauga

SEQ ID NO: 1828 - RNA, 19 nt, Homo sapiens
cacuugaaaaugaaaugac

SEQ ID NO: 1829 - RNA, 19 nt, Homo sapiens
acuugaaaaugaaaugacu

SEQ ID NO: 1830 - RNA, 19 nt, Homo sapiens
cuugaaaaugaaaugacug

SEQ ID NO: 1831 - RNA, 19 nt, Homo sapiens
uugaaaaugaaaugacugu

SEQ ID NO: 1832 - RNA, 19 nt, Homo sapiens
ugaaaaugaaaugacuguc

SEQ ID NO: 1833 - RNA, 19 nt, Homo sapiens
gaaaaugaaaugacugucu

SEQ ID NO: 1834 - RNA, 19 nt, Homo sapiens
aaaaugaaaugacugucua

SEQ ID NO: 1835 - RNA, 19 nt, Homo sapiens
aaaugaaaugacugucuaa

SEQ ID NO: 1836 - RNA, 19 nt, Homo sapiens
aaugaaaugacugucuaag

SEQ ID NO: 1837 - RNA, 19 nt, Homo sapiens
augaaaugacugucuaaga

SEQ ID NO: 1838 - RNA, 19 nt, Homo sapiens
ugaaaugacugucuaagag

SEQ ID NO: 1839 - RNA, 19 nt, Homo sapiens
gaaaugacugucuaagaga

SEQ ID NO: 1840 - RNA, 19 nt, Homo sapiens
aaaugacugucuaagagau

SEQ ID NO: 1841 - RNA, 19 nt, Homo sapiens
augacugucuaagagaucu

SEQ ID NO: 1842 - RNA, 19 nt, Homo sapiens
ugacugucuaagagaucug

SEQ ID NO: 1843 - RNA, 19 nt, Homo sapiens
gacugucuaagagaucugg

SEQ ID NO: 1844 - RNA, 19 nt, Homo sapiens
acugucuaagagaucuggu

SEQ ID NO: 1845 - RNA, 19 nt, Homo sapiens
cugucuaagagaucugguc

SEQ ID NO: 1846 - RNA, 19 nt, Homo sapiens
ugucuaagagaucugguca

SEQ ID NO: 1847 - RNA, 19 nt, Homo sapiens
gucuaagagaucuggucaa

SEQ ID NO: 1848 - RNA, 19 nt, Homo sapiens
ucuaagagaucuggucaaa

SEQ ID NO: 1849 - RNA, 19 nt, Homo sapiens
cuaagagaucuggucaaag

SEQ ID NO: 1850 - RNA, 19 nt, Homo sapiens
uaagagaucuggucaaagc

SEQ ID NO: 1851 - RNA, 19 nt, Homo sapiens
aagagaucuggucaaagca

SEQ ID NO: 1852 - RNA, 19 nt, Homo sapiens
agagaucuggucaaagcaa

SEQ ID NO: 1853 - RNA, 19 nt, Homo sapiens
gagaucuggucaaagcaac

SEQ ID NO: 1854 - RNA, 19 nt, Homo sapiens
agaucuggucaaagcaacu

SEQ ID NO: 1855 - RNA, 19 nt, Homo sapiens
gaucuggucaaagcaacug

SEQ ID NO: 1856 - RNA, 19 nt, Homo sapiens
aucuggucaaagcaacugg

SEQ ID NO: 1857 - RNA, 19 nt, Homo sapiens
ucuggucaaagcaacugga

SEQ ID NO: 1858 - RNA, 19 nt, Homo sapiens
cuggucaaagcaacuggau

SEQ ID NO: 1859 - RNA, 19 nt, Homo sapiens
uggucaaagcaacuggaua

SEQ ID NO: 1860 - RNA, 19 nt, Homo sapiens
ggucaaagcaacuggauac

SEQ ID NO: 1861 - RNA, 19 nt, Homo sapiens
gucaaagcaacuggauacu

SEQ ID NO: 1862 - RNA, 19 nt, Homo sapiens
ucaaagcaacuggauacua

SEQ ID NO: 1863 - RNA, 19 nt, Homo sapiens
caaagcaacuggauacuag

SEQ ID NO: 1864 - RNA, 19 nt, Homo sapiens
aaagcaacuggauacuaga

SEQ ID NO: 1865 - RNA, 19 nt, Homo sapiens
aagcaacuggauacuagau

SEQ ID NO: 1866 - RNA, 19 nt, Homo sapiens
agcaacuggauacuagauc

SEQ ID NO: 1867 - RNA, 19 nt, Homo sapiens
gcaacuggauacuagaucu

SEQ ID NO: 1868 - RNA, 19 nt, Homo sapiens
caacuggauacuagaucuu

SEQ ID NO: 1869 - RNA, 19 nt, Homo sapiens
aacuggauacuagaucuua

SEQ ID NO: 1870 - RNA, 19 nt, Homo sapiens
acuggauacuagaucuuac

SEQ ID NO: 1871 - RNA, 19 nt, Homo sapiens
cuggauacuagaucuuaca

SEQ ID NO: 1872 - RNA, 19 nt, Homo sapiens
uggauacuagaucuuacau

SEQ ID NO: 1873 - RNA, 19 nt, Homo sapiens
ggauacuagaucuuacauc

SEQ ID NO: 1874 - RNA, 19 nt, Homo sapiens
gauacuagaucuuacaucu

SEQ ID NO: 1875 - RNA, 19 nt, Homo sapiens
auacuagaucuuacaucug

SEQ ID NO: 1876 - RNA, 19 nt, Homo sapiens
acuagaucuuacaucugca

SEQ ID NO: 1877 - RNA, 19 nt, Homo sapiens
cuagaucuuacaucugcag

SEQ ID NO: 1878 - RNA, 19 nt, Homo sapiens
agaucuuacaucugcagcu

SEQ ID NO: 1879 - RNA, 19 nt, Homo sapiens
gaucuuacaucugcagcuc

SEQ ID NO: 1880 - RNA, 19 nt, Homo sapiens
aucuuacaucugcagcucu

SEQ ID NO: 1881 - RNA, 19 nt, Homo sapiens
ucuuacaucugcagcucuu

SEQ ID NO: 1882 - RNA, 19 nt, Homo sapiens
cuuacaucugcagcucuuu

SEQ ID NO: 1883 - RNA, 19 nt, Homo sapiens
uuacaucugcagcucuuuc

SEQ ID NO: 1884 - RNA, 19 nt, Homo sapiens
uacaucugcagcucuuucu

SEQ ID NO: 1885 - RNA, 19 nt, Homo sapiens
acaucugcagcucuuucuu

SEQ ID NO: 1886 - RNA, 19 nt, Homo sapiens
caucugcagcucuuucuuc

SEQ ID NO: 1887 - RNA, 19 nt, Homo sapiens
aucugcagcucuuucuucu

SEQ ID NO: 1888 - RNA, 19 nt, Homo sapiens
ucugcagcucuuucuucuu

SEQ ID NO: 1889 - RNA, 19 nt, Homo sapiens
cugcagcucuuucuucuuu

SEQ ID NO: 1890 - RNA, 19 nt, Homo sapiens
ugcagcucuuucuucuuug

SEQ ID NO: 1891 - RNA, 19 nt, Homo sapiens
gcagcucuuucuucuuuga

SEQ ID NO: 1892 - RNA, 19 nt, Homo sapiens
cagcucuuucuucuuugaa

SEQ ID NO: 1893 - RNA, 19 nt, Homo sapiens
agcucuuucuucuuugaau

SEQ ID NO: 1894 - RNA, 19 nt, Homo sapiens
gcucuuucuucuuugaauu

SEQ ID NO: 1895 - RNA, 19 nt, Homo sapiens
cucuuucuucuuugaauuu

SEQ ID NO: 1896 - RNA, 19 nt, Homo sapiens
ucuuucuucuuugaauuuc

SEQ ID NO: 1897 - RNA, 19 nt, Homo sapiens
cuuucuucuuugaauuucc

SEQ ID NO: 1898 - RNA, 19 nt, Homo sapiens
uuucuucuuugaauuuccu

SEQ ID NO: 1899 - RNA, 19 nt, Homo sapiens
uucuucuuugaauuuccua

SEQ ID NO: 1900 - RNA, 19 nt, Homo sapiens
ucuucuuugaauuuccuau

SEQ ID NO: 1901 - RNA, 19 nt, Homo sapiens
uucuuugaauuuccuaucu

SEQ ID NO: 1902 - RNA, 19 nt, Homo sapiens
ucuuugaauuuccuaucug

SEQ ID NO: 1903 - RNA, 19 nt, Homo sapiens
cuuugaauuuccuaucugu

SEQ ID NO: 1904 - RNA, 19 nt, Homo sapiens
uuugaauuuccuaucugua

SEQ ID NO: 1905 - RNA, 19 nt, Homo sapiens
uugaauuuccuaucuguau

SEQ ID NO: 1906 - RNA, 19 nt, Homo sapiens
ugaauuuccuaucuguaug

SEQ ID NO: 1907 - RNA, 19 nt, Homo sapiens
gaauuuccuaucuguaugu

SEQ ID NO: 1908 - RNA, 19 nt, Homo sapiens
auuuccuaucuguaugucu

SEQ ID NO: 1909 - RNA, 19 nt, Homo sapiens
uuuccuaucuguaugucug

SEQ ID NO: 1910 - RNA, 19 nt, Homo sapiens
uuccuaucuguaugucugc

SEQ ID NO: 1911 - RNA, 19 nt, Homo sapiens
uccuaucuguaugucugcc

SEQ ID NO: 1912 - RNA, 19 nt, Homo sapiens
ccuaucuguaugucugccu

SEQ ID NO: 1913 - RNA, 19 nt, Homo sapiens
cuaucuguaugucugccua

SEQ ID NO: 1914 - RNA, 19 nt, Homo sapiens
uaucuguaugucugccuaa

SEQ ID NO: 1915 - RNA, 19 nt, Homo sapiens
aucuguaugucugccuaau

SEQ ID NO: 1916 - RNA, 19 nt, Homo sapiens
ucuguaugucugccuaauu

SEQ ID NO: 1917 - RNA, 19 nt, Homo sapiens
cuguaugucugccuaauua

SEQ ID NO: 1918 - RNA, 19 nt, Homo sapiens
uguaugucugccuaauuaa

SEQ ID NO: 1919 - RNA, 19 nt, Homo sapiens
guaugucugccuaauuaaa

SEQ ID NO: 1920 - RNA, 19 nt, Homo sapiens
uaugucugccuaauuaaaa

SEQ ID NO: 1921 - RNA, 19 nt, Homo sapiens
augucugccuaauuaaaaa

SEQ ID NO: 1922 - RNA, 19 nt, Homo sapiens
ugucugccuaauuaaaaaa

SEQ ID NO: 1923 - RNA, 19 nt, Homo sapiens
gucugccuaauuaaaaaaa

SEQ ID NO: 1924 - RNA, 19 nt, Homo sapiens
ucugccuaauuaaaaaaau

SEQ ID NO: 1925 - RNA, 19 nt, Homo sapiens
cugccuaauuaaaaaaaua

SEQ ID NO: 1926 - RNA, 19 nt, Homo sapiens
ugccuaauuaaaaaaauau

SEQ ID NO: 1927 - RNA, 19 nt, Homo sapiens
gccuaauuaaaaaaauaua

SEQ ID NO: 1928 - RNA, 19 nt, Homo sapiens
ccuaauuaaaaaaauauau

SEQ ID NO: 1929 - RNA, 19 nt, Homo sapiens
cuaauuaaaaaaauauaua

SEQ ID NO: 1930 - RNA, 19 nt, Homo sapiens
uaaaaaaauauauauugua

SEQ ID NO: 1931 - RNA, 21 nt, Artificial Sequence
  siRNA sense strand against APCS
  modified_base (1)..(1): 2'-fluorouracil
  modified_base (2)..(2): 2'-O-methyladenosine
  modified_base (3)..(3): 2'-fluorocytosine
  modified_base (4)..(4): cm
  modified_base (5)..(5): 2'-fluorouracil
  modified_base (6)..(6): um
  modified_base (7)..(7): 2'-fluoroguanine
  modified_base (8)..(8): um
  modified_base (9)..(9): 2'-fluoroguanine
  modified_base (10)..(10): um
  modified_base (11)..(12): 2'-fluorouracil
  modified_base (13)..(13): um
  modified_base (14)..(14): 2'-fluorocytosine
  modified_base (15)..(15): gm
  modified_base (16)..(16): 2'-fluoroadenine
  modified_base (17)..(17): gm
  modified_base (18)..(18): 2'-fluorocytosine
  modified_base (19)..(19): cm
  modified_base (20)..(20): 2'-fluorouracil
  modified_base (21)..(21): 2'-O-methyladenosine
uaccuuguguuuucgagccua

SEQ ID NO: 1932 - RNA, 21 nt, Artificial Sequence
  siRNA sense strand against APCS
  modified_base (1)..(1): 2'-fluorouracil
  modified_base (2)..(2): gm
  modified_base (3)..(3): 2'-fluorocytosine
  modified_base (4)..(4): cm
  modified_base (5)..(5): 2'-fluorouracil
  modified_base (6)..(6): 2'-O-methyladenosine
  modified_base (7)..(7): 2'-fluorocytosine
  modified_base (8)..(8): 2'-O-methyladenosine
  modified_base (9)..(9): 2'-fluoroguanine
  modified_base (10)..(10): cm
  modified_base (11)..(11): 2'-fluorocytosine
  modified_base (12)..(12): 2'-fluorouracil
  modified_base (13)..(13): cm
  modified_base (14)..(14): 2'-fluorouracil
  modified_base (15)..(15): um
  modified_base (16)..(16): 2'-fluorocytosine
  modified_base (17)..(17): um
  modified_base (18)..(18): 2'-fluorocytosine
  modified_base (19)..(19): cm
  modified_base (20)..(20): 2'-fluorouracil
  modified_base (21)..(21): 2'-O-methyladenosine
ugccuacagccucuucuccua

SEQ ID NO: 1933 - RNA, 21 nt, Artificial Sequence
  siRNA sense strand against APCS
  modified_base (1)..(1): 2'-fluoroadenine
  modified_base (2)..(2): cm
  modified_base (3)..(3): 2'-fluoroadenine
  modified_base (4)..(4): gm
  modified_base (5)..(5): 2'-fluorocytosine
  modified_base (6)..(6): cm
  modified_base (7)..(7): 2'-fluorouracil
  modified_base (8)..(8): cm
  modified_base (9)..(9): 2'-fluorouracil
  modified_base (10)..(10): um
  modified_base (11)..(11): 2'-fluorocytosine
  modified_base (12)..(12): 2'-fluorouracil
  modified_base (13)..(13): cm
  modified_base (14)..(14): 2'-fluorocytosine
  modified_base (15)..(15): um
  modified_base (16)..(16): 2'-fluoroadenine
  modified_base (17)..(17): cm
  modified_base (18)..(18): 2'-fluoroadenine
  modified_base (19)..(19): 2'-O-methyladenosine
  modified_base (20)..(20): 2'-fluorouracil
  modified_base (21)..(21): 2'-O-methyladenosine
acagccucuucuccuacaaua

SEQ ID NO: 1934 - RNA, 21 nt, Artificial Sequence
  siRNA sense strand against APCS
  modified_base (1)..(1): 2'-fluoroguanine
  modified_base (2)..(2): um
  modified_base (3)..(3): 2'-fluorocytosine
  modified_base (4)..(4): cm
  modified_base (5)..(5): 2'-fluorouracil
  modified_base (6)..(6): cm
  modified_base (7)..(7): 2'-fluoroadenine
  modified_base (8)..(8): um
  modified_base (9)..(9): 2'-fluorocytosine
  modified_base (10)..(10): 2'-O-methyladenosine
  modified_base (11)..(12): 2'-fluoroguanine
  modified_base (13)..(13): um
  modified_base (14)..(14): 2'-fluoroadenine
  modified_base (15)..(15): um
  modified_base (16)..(16): 2'-fluorouracil
  modified_base (17)..(17): gm
  modified_base (18)..(18): 2'-fluorocytosine
  modified_base (19)..(19): um
  modified_base (20)..(20): 2'-fluoroguanine
  modified_base (21)..(21): 2'-O-methyladenosine
guccucaucagguauugcuga

SEQ ID NO: 1935 - RNA, 21 nt, Artificial Sequence
  siRNA sense strand against APCS
  modified_base (1)..(1): 2'-fluoroadenine
  modified_base (2)..(2): gm
  modified_base (3)..(3): 2'-fluoroguanine
  modified_base (4)..(4): 2'-O-methyladenosine
  modified_base (5)..(5): 2'-fluoroguanine
  modified_base (6)..(6): cm
  modified_base (7)..(7): 2'-fluorocytosine
  modified_base (8)..(8): 2'-O-methyladenosine
  modified_base (9)..(9): 2'-fluoroguanine
  modified_base (10)..(10): um
  modified_base (11)..(12): 2'-fluorocytosine
  modified_base (13)..(13): um
  modified_base (14)..(14): 2'-fluorouracil
  modified_base (15)..(15): um
  modified_base (16)..(16): 2'-fluoroguanine
  modified_base (17)..(17): um
  modified_base (18)..(18): 2'-fluoroguanine
  modified_base (19)..(19): gm
  modified_base (20)..(20): 2'-fluoroguanine
  modified_base (21)..(21): 2'-O-methyladenosine
aggagccaguccuuuguggga

SEQ ID NO: 1936 - RNA, 21 nt, Artificial Sequence
  siRNA sense strand against APCS
  modified_base (1)..(1): 2'-fluoroguanine
  modified_base (2)..(2): 2'-O-methyladenosine
  modified_base (3)..(3): 2'-fluoroguanine
  modified_base (4)..(4): cm
  modified_base (5)..(5): 2'-fluorocytosine
  modified_base (6)..(6): 2'-O-methyladenosine
  modified_base (7)..(7): 2'-fluoroguanine
  modified_base (8)..(8): um
  modified_base (9)..(9): 2'-fluorocytosine
  modified_base (10)..(10): cm
  modified_base (11)..(12): 2'-fluorouracil
  modified_base (13)..(13): um
  modified_base (14)..(14): 2'-fluoroguanine
  modified_base (15)..(15): um
  modified_base (16)..(16): 2'-fluoroguanine
  modified_base (17)..(17): gm
  modified_base (18)..(18): 2'-fluoroguanine
  modified_base (19)..(19): 2'-O-methyladenosine
  modified_base (20)..(20): 2'-fluoroguanine
  modified_base (21)..(21): 2'-O-methyladenosine
gagccaguccuuugugggaga

SEQ ID NO: 1937 - RNA, 21 nt, Artificial Sequence
  siRNA sense strand against APCS
  modified_base (1)..(1): 2'-fluorocytosine
  modified_base (2)..(2): cm
  modified_base (3)..(3): 2'-fluoroadenine
  modified_base (4)..(4): gm
  modified_base (5)..(5): 2'-fluorouracil
  modified_base (6)..(6): cm
  modified_base (7)..(7): 2'-fluorocytosine
  modified_base (8)..(8): um
  modified_base (9)..(9): 2'-fluorouracil
  modified_base (10)..(10): um
  modified_base (11)..(11): 2'-fluoroguanine
  modified_base (12)..(12): 2'-fluorouracil
  modified_base (13)..(13): gm
  modified_base (14)..(14): 2'-fluoroguanine
  modified_base (15)..(15): gm
  modified_base (16)..(16): 2'-fluoroadenine
  modified_base (17)..(17): gm
  modified_base (18)..(18): 2'-fluoroadenine
  modified_base (19)..(19): gm
  modified_base (20)..(20): 2'-fluoroadenine
  modified_base (21)..(21): um
ccaguccuuugugggagagau

SEQ ID NO: 1938 - RNA, 21 nt, Artificial Sequence
  siRNA sense strand against APCS
  modified_base (1)..(1): 2'-fluorocytosine
  modified_base (2)..(2): 2'-O-methyladenosine
  modified_base (3)..(3): 2'-fluoroguanine
  modified_base (4)..(4): um
  modified_base (5)..(5): 2'-fluorocytosine
  modified_base (6)..(6): cm
  modified_base (7)..(7): 2'-fluorouracil
  modified_base (8)..(8): um
  modified_base (9)..(9): 2'-fluorouracil
  modified_base (10)..(10): gm
  modified_base (11)..(11): 2'-fluorouracil
  modified_base (12)..(12): 2'-fluoroguanine
  modified_base (13)..(13): gm
  modified_base (14)..(14): 2'-fluoroguanine
  modified_base (15)..(15): 2'-O-methyladenosine
  modified_base (16)..(16): 2'-fluoroguanine
  modified_base (17)..(17): 2'-O-methyladenosine
  modified_base (18)..(18): 2'-fluoroguanine
  modified_base (19)..(19): 2'-O-methyladenosine
  modified_base (20)..(20): 2'-fluorouracil
  modified_base (21)..(21): um
caguccuuugugggagagauu

SEQ ID NO: 1939 - RNA, 21 nt, Artificial Sequence
  siRNA sense strand against APCS
  modified_base (1)..(1): 2'-fluorouracil
  modified_base (2)..(2): gm
  modified_base (3)..(3): 2'-fluoroguanine
  modified_base (4)..(4): gm
  modified_base (5)..(5): 2'-fluoroadenine
  modified_base (6)..(6): gm
  modified_base (7)..(7): 2'-fluoroadenine
  modified_base (8)..(8): gm
  modified_base (9)..(9): 2'-fluoroadenine
  modified_base (10)..(10): um
  modified_base (11)..(11): 2'-fluorouracil
  modified_base (12)..(12): 2'-fluoroguanine
  modified_base (13)..(13): gm
  modified_base (14)..(14): 2'-fluoroguanine
  modified_base (15)..(15): gm
  modified_base (16)..(16): 2'-fluoroadenine
  modified_base (17)..(17): um
  modified_base (18)..(18): 2'-fluorouracil
  modified_base (19)..(19): um
  modified_base (20)..(20): 2'-fluoroguanine
  modified_base (21)..(21): um
ugggagagauuggggauuugu

SEQ ID NO: 1940 - RNA, 21 nt, Artificial Sequence
  siRNA sense strand against APCS
  modified_base (1)..(1): 2'-fluoroguanine
  modified_base (2)..(2): gm
  modified_base (3)..(3): 2'-fluoroguanine
  modified_base (4)..(4): 2'-O-methyladenosine
  modified_base (5)..(5): 2'-fluoroguanine
  modified_base (6)..(6): 2'-O-methyladenosine
  modified_base (7)..(7): 2'-fluoroguanine
  modified_base (8)..(8): 2'-O-methyladenosine
  modified_base (9)..(9): 2'-fluorouracil
  modified_base (10)..(10): um
  modified_base (11)..(12): 2'-fluoroguanine
  modified_base (13)..(13): gm
  modified_base (14)..(14): 2'-fluoroguanine
  modified_base (15)..(15): 2'-O-methyladenosine
  modified_base (16)..(16): 2'-fluorouracil
  modified_base (17)..(17): um
  modified_base (18)..(18): 2'-fluorouracil
  modified_base (19)..(19): gm
  modified_base (20)..(20): 2'-fluorouracil
  modified_base (21)..(21): 2'-O-methyladenosine
gggagagauuggggauuugua

SEQ ID NO: 1941 - RNA, 21 nt, Artificial Sequence
  siRNA sense strand against APCS
  modified_base (1)..(1): 2'-fluoroguanine
  modified_base (2)..(2): 2'-O-methyladenosine
  modified_base (3)..(3): 2'-fluoroguanine
  modified_base (4)..(4): 2'-O-methyladenosine
  modified_base (5)..(5): 2'-fluoroguanine
  modified_base (6)..(6): 2'-O-methyladenosine
  modified_base (7)..(7): 2'-fluorouracil
  modified_base (8)..(8): um
  modified_base (9)..(9): 2'-fluoroguanine
  modified_base (10)..(10): gm
  modified_base (11)..(12): 2'-fluoroguanine
  modified_base (13)..(13): 2'-O-methyladenosine
  modified_base (14)..(14): 2'-fluorouracil
  modified_base (15)..(15): um
  modified_base (16)..(16): 2'-fluorouracil
  modified_base (17)..(17): gm
  modified_base (18)..(18): 2'-fluorouracil
  modified_base (19)..(19): 2'-O-methyladenosine
  modified_base (20)..(20): 2'-fluorocytosine
  modified_base (21)..(21): 2'-O-methyladenosine
gagagauuggggauuuguaca

SEQ ID NO: 1942 - RNA, 21 nt, Artificial Sequence
  siRNA sense strand against APCS
  modified_base (1)..(1): 2'-fluorouracil
  modified_base (2)..(2): cm
  modified_base (3)..(3): 2'-fluorocytosine
  modified_base (4)..(4): um
  modified_base (5)..(5): 2'-fluoroguanine
  modified_base (6)..(6): um
  modified_base (7)..(7): 2'-fluorocytosine
  modified_base (8)..(8): um
  modified_base (9)..(9): 2'-fluoroguanine
  modified_base (10)..(10): cm
  modified_base (11)..(11): 2'-fluorocytosine
  modified_base (12)..(12): 2'-fluorouracil
  modified_base (13)..(13): 2'-O-methyladenosine
  modified_base (14)..(14): 2'-fluorouracil
  modified_base (15)..(15): cm
  modified_base (16)..(16): 2'-fluoroadenine
  modified_base (17)..(17): gm
  modified_base (18)..(18): 2'-fluoroguanine
  modified_base (19)..(19): gm
  modified_base (20)..(20): 2'-fluorouracil
  modified_base (21)..(21): 2'-O-methyladenosine
uccugucugccuaucagggua

SEQ ID NO: 1943 - RNA, 21 nt, Artificial Sequence
  siRNA sense strand against APCS
  modified_base (1)..(1): 2'-fluorocytosine
  modified_base (2)..(2): 2'-O-methyladenosine
  modified_base (3)..(3): 2'-fluoroguanine
  modified_base (4)..(4): gm
  modified_base (5)..(5): 2'-fluorocytosine
  modified_base (6)..(6): um
  modified_base (7)..(7): 2'-fluorocytosine
  modified_base (8)..(8): um
  modified_base (9)..(9): 2'-fluoroguanine
  modified_base (10)..(10): 2'-O-methyladenosine
  modified_base (11)..(11): 2'-fluoroadenine
  modified_base (12)..(12): 2'-fluorocytosine
  modified_base (13)..(13): um
  modified_base (14)..(14): 2'-fluoroadenine
  modified_base (15)..(15): um
  modified_base (16)..(16): 2'-fluoroguanine
  modified_base (17)..(17): 2'-O-methyladenosine
  modified_base (18)..(18): 2'-fluoroadenine
  modified_base (19)..(19): 2'-O-methyladenosine
  modified_base (20)..(20): 2'-fluorouracil
  modified_base (21)..(21): cm
caggcucugaacuaugaaauc

SEQ ID NO: 1944 - RNA, 21 nt, Artificial Sequence
  siRNA sense strand against APCS
  modified_base (1)..(1): 2'-fluoroguanine
  modified_base (2)..(2): 2'-O-methyladenosine
  modified_base (3)..(3): 2'-fluoroguanine
  modified_base (4)..(4): gm
  modified_base (5)..(5): 2'-fluoroadenine
  modified_base (6)..(6): um
  modified_base (7)..(7): 2'-fluoroadenine
  modified_base (8)..(8): um
  modified_base (9)..(9): 2'-fluoroguanine
  modified_base (10)..(10): um
  modified_base (11)..(11): 2'-fluorocytosine
  modified_base (12)..(12): 2'-fluoroadenine
  modified_base (13)..(13): um
  modified_base (14)..(14): 2'-fluorocytosine
  modified_base (15)..(15): 2'-O-methyladenosine
  modified_base (16)..(16): 2'-fluorouracil
  modified_base (17)..(17): cm
  modified_base (18)..(18): 2'-fluoroadenine
  modified_base (19)..(19): 2'-O-methyladenosine
  modified_base (20)..(20): 2'-fluoroadenine
  modified_base (21)..(21): cm
gaggauaugucaucaucaaac

SEQ ID NO: 1945 - RNA, 21 nt, Artificial Sequence
  siRNA sense strand against APCS
  modified_base (1)..(1): 2'-fluorouracil
  modified_base (2)..(2): gm
  modified_base (3)..(3): 2'-fluoroguanine
  modified_base (4)..(4): gm
  modified_base (5)..(5): 2'-fluorouracil
  modified_base (6)..(6): cm
  modified_base (7)..(7): 2'-fluorouracil
  modified_base (8)..(8): gm
  modified_base (9)..(9): 2'-fluoroadenine
  modified_base (10)..(10): gm
  modified_base (11)..(11): 2'-fluoroguanine
  modified_base (12)..(12): 2'-fluorouracil
  modified_base (13)..(13): cm
  modified_base (14)..(14): 2'-fluorouracil
  modified_base (15)..(15): um
  modified_base (16)..(16): 2'-fluoroguanine
  modified_base (17)..(17): 2'-O-methyladenosine
  modified_base (18)..(18): 2'-fluorocytosine
  modified_base (19)..(19): um
  modified_base (20)..(20): 2'-fluorocytosine
  modified_base (21)..(21): 2'-O-methyladenosine
ugggucugaggucuugacuca

SEQ ID NO: 1946 - RNA, 21 nt, Artificial Sequence
  siRNA sense strand against APCS
  modified_base (1)..(1): 2'-fluoroadenine
  modified_base (2)..(2): cm
  modified_base (3)..(3): 2'-fluorouracil
  modified_base (4)..(4): cm
  modified_base (5)..(5): 2'-fluoroadenine
  modified_base (6)..(6): 2'-O-methyladenosine
  modified_base (7)..(7): 2'-fluorocytosine
  modified_base (8)..(8): gm
  modified_base (9)..(9): 2'-fluoroadenine
  modified_base (10)..(10): gm
  modified_base (11)..(11): 2'-fluoroadenine
  modified_base (12)..(12): 2'-fluoroguanine
  modified_base (13)..(13): cm
  modified_base (14)..(14): 2'-fluoroadenine
  modified_base (15)..(15): cm
  modified_base (16)..(16): 2'-fluorouracil
  modified_base (17)..(17): um
  modified_base (18)..(18): 2'-fluoroguanine
  modified_base (19)..(19): 2'-O-methyladenosine
  modified_base (20)..(20): 2'-fluoroadenine
  modified_base (21)..(21): 2'-O-methyladenosine
acucaacgagagcacuugaaa

SEQ ID NO: 1947 - RNA, 21 nt, Artificial Sequence
  siRNA sense strand against APCS
  modified_base (1)..(1): 2'-fluorocytosine
  modified_base (2)..(2): um
  modified_base (3)..(3): 2'-fluorocytosine
  modified_base (4)..(4): 2'-O-methyladenosine
  modified_base (5)..(5): 2'-fluoroadenine
  modified_base (6)..(6): cm
  modified_base (7)..(7): 2'-fluoroguanine
  modified_base (8)..(8): 2'-O-methyladenosine
  modified_base (9)..(9): 2'-fluoroguanine
  modified_base (10)..(10): 2'-O-methyladenosine
  modified_base (11)..(11): 2'-fluoroguanine
  modified_base (12)..(12): 2'-fluorocytosine
  modified_base (13)..(13): 2'-O-methyladenosine
  modified_base (14)..(14): 2'-fluorocytosine
  modified_base (15)..(15): um
  modified_base (16)..(16): 2'-fluorouracil
  modified_base (17)..(17): gm
  modified_base (18)..(18): 2'-fluoroadenine
  modified_base (19)..(19): 2'-O-methyladenosine
  modified_base (20)..(20): 2'-fluoroadenine
  modified_base (21)..(21): 2'-O-methyladenosine
cucaacgagagcacuugaaaa

SEQ ID NO: 1948 - RNA, 21 nt, Artificial Sequence
  siRNA sense strand against APCS
  modified_base (1)..(1): 2'-fluorouracil
  modified_base (2)..(2): cm
  modified_base (3)..(3): 2'-fluoroadenine
  modified_base (4)..(4): 2'-O-methyladenosine
  modified_base (5)..(5): 2'-fluorocytosine
  modified_base (6)..(6): gm
  modified_base (7)..(7): 2'-fluoroadenine
  modified_base (8)..(8): gm
  modified_base (9)..(9): 2'-fluoroadenine
  modified_base (10)..(10): gm
  modified_base (11)..(11): 2'-fluorocytosine
  modified_base (12)..(12): 2'-fluoroadenine
  modified_base (13)..(13): cm
  modified_base (14)..(14): 2'-fluorouracil
  modified_base (15)..(15): um
  modified_base (16)..(16): 2'-fluoroguanine
  modified_base (17)..(17): 2'-O-methyladenosine
  modified_base (18)..(18): 2'-fluoroadenine
  modified_base (19)..(19): 2'-O-methyladenosine
  modified_base (20)..(20): 2'-fluoroadenine
  modified_base (21)..(21): um
ucaacgagagcacuugaaaau

SEQ ID NO: 1949 - RNA, 21 nt, Artificial Sequence
  siRNA sense strand against APCS
  modified_base (1)..(1): 2'-fluoroadenine
  modified_base (2)..(2): 2'-O-methyladenosine
  modified_base (3)..(3): 2'-fluorocytosine
  modified_base (4)..(4): gm
  modified_base (5)..(5): 2'-fluoroadenine
  modified_base (6)..(6): gm
  modified_base (7)..(7): 2'-fluoroadenine
  modified_base (8)..(8): gm
  modified_base (9)..(9): 2'-fluorocytosine
  modified_base (10)..(10): 2'-O-methyladenosine
  modified_base (11)..(11): 2'-fluorocytosine
  modified_base (12)..(12): 2'-fluorouracil
  modified_base (13)..(13): um
  modified_base (14)..(14): 2'-fluoroguanine
  modified_base (15)..(15): 2'-O-methyladenosine
  modified_base (16)..(16): 2'-fluoroadenine
  modified_base (17)..(17): 2'-O-methyladenosine
  modified_base (18)..(18): 2'-fluoroadenine
  modified_base (19)..(19): um
  modified_base (20)..(20): 2'-fluoroguanine
  modified_base (21)..(21): 2'-O-methyladenosine
aacgagagcacuugaaaauga

SEQ ID NO: 1950 - RNA, 21 nt, Artificial Sequence
  siRNA sense strand against APCS
  modified_base (1)..(1): 2'-fluoroadenine
  modified_base (2)..(2): cm
  modified_base (3)..(3): 2'-fluoroguanine
  modified_base (4)..(4): 2'-O-methyladenosine
  modified_base (5)..(5): 2'-fluoroguanine
  modified_base (6)..(6): 2'-O-methyladenosine
  modified_base (7)..(7): 2'-fluoroguanine
  modified_base (8)..(8): cm
  modified_base (9)..(9): 2'-fluoroadenine
  modified_base (10)..(10): cm
  modified_base (11)..(12): 2'-fluorouracil
  modified_base (13)..(13): gm
  modified_base (14)..(14): 2'-fluoroadenine
  modified_base (15)..(15): 2'-O-methyladenosine
  modified_base (16)..(16): 2'-fluoroadenine
  modified_base (17)..(17): 2'-O-methyladenosine
  modified_base (18)..(18): 2'-fluorouracil
  modified_base (19)..(19): gm
  modified_base (20)..(20): 2'-fluoroadenine
  modified_base (21)..(21): 2'-O-methyladenosine
acgagagcacuugaaaaugaa

SEQ ID NO: 1951 - RNA, 21 nt, Artificial Sequence
  siRNA sense strand against APCS
  modified_base (1)..(1): 2'-fluorocytosine
  modified_base (2)..(2): gm
  modified_base (3)..(3): 2'-fluoroadenine
  modified_base (4)..(4): gm
  modified_base (5)..(5): 2'-fluoroadenine
  modified_base (6)..(6): gm
  modified_base (7)..(7): 2'-fluorocytosine
  modified_base (8)..(8): 2'-O-methyladenosine
  modified_base (9)..(9): 2'-fluorocytosine
  modified_base (10)..(10): um
  modified_base (11)..(11): 2'-fluorouracil
  modified_base (12)..(12): 2'-fluoroguanine
  modified_base (13)..(13): 2'-O-methyladenosine
  modified_base (14)..(14): 2'-fluoroadenine
  modified_base (15)..(15): 2'-O-methyladenosine
  modified_base (16)..(16): 2'-fluoroadenine
  modified_base (17)..(17): um
  modified_base (18)..(18): 2'-fluoroguanine
  modified_base (19)..(19): 2'-O-methyladenosine
  modified_base (20)..(20): 2'-fluoroadenine
  modified_base (21)..(21): 2'-O-methyladenosine
cgagagcacuugaaaaugaaa

SEQ ID NO: 1952 - RNA, 21 nt, Artificial Sequence
  siRNA sense strand against APCS
  modified_base (1)..(1): 2'-fluoroguanine
  modified_base (2)..(2): 2'-O-methyladenosine
  modified_base (3)..(3): 2'-fluoroguanine
  modified_base (4)..(4): 2'-O-methyladenosine
  modified_base (5)..(5): 2'-fluoroguanine
  modified_base (6)..(6): cm
  modified_base (7)..(7): 2'-fluoroadenine
  modified_base (8)..(8): cm
  modified_base (9)..(9): 2'-fluorouracil
  modified_base (10)..(10): um
  modified_base (11)..(11): 2'-fluoroguanine
  modified_base (12)..(12): 2'-fluoroadenine
  modified_base (13)..(13): 2'-O-methyladenosine
  modified_base (14)..(14): 2'-fluoroadenine
  modified_base (15)..(15): 2'-O-methyladenosine
  modified_base (16)..(16): 2'-fluorouracil
  modified_base (17)..(17): gm
  modified_base (18)..(18): 2'-fluoroadenine
  modified_base (19)..(19): 2'-O-methyladenosine
  modified_base (20)..(20): 2'-fluoroadenine
  modified_base (21)..(21): um
gagagcacuugaaaaugaaau

SEQ ID NO: 1953 - RNA, 21 nt, Artificial Sequence
  siRNA sense strand against APCS
  modified_base (1)..(1): 2'-fluoroadenine
  modified_base (2)..(2): gm
  modified_base (3)..(3): 2'-fluoroadenine
  modified_base (4)..(4): gm
  modified_base (5)..(5): 2'-fluorocytosine
  modified_base (6)..(6): 2'-O-methyladenosine
  modified_base (7)..(7): 2'-fluorocytosine
  modified_base (8)..(8): um
  modified_base (9)..(9): 2'-fluorouracil
  modified_base (10)..(10): gm
  modified_base (11)..(12): 2'-fluoroadenine
  modified_base (13)..(13): 2'-O-methyladenosine
  modified_base (14)..(14): 2'-fluoroadenine
  modified_base (15)..(15): um
  modified_base (16)..(16): 2'-fluoroguanine
  modified_base (17)..(17): 2'-O-methyladenosine
  modified_base (18)..(18): 2'-fluoroadenine
  modified_base (19)..(19): 2'-O-methyladenosine
  modified_base (20)..(20): 2'-fluorouracil
  modified_base (21)..(21): gm
agagcacuugaaaaugaaaug

SEQ ID NO: 1954 - RNA, 21 nt, Artificial Sequence
  siRNA sense strand against APCS
  modified_base (1)..(1): 2'-fluorocytosine
  modified_base (2)..(2): um
  modified_base (3)..(3): 2'-fluoroadenine
  modified_base (4)..(4): 2'-O-methyladenosine
  modified_base (5)..(5): 2'-fluoroguanine
  modified_base (6)..(6): 2'-O-methyladenosine
  modified_base (7)..(7): 2'-fluoroguanine
  modified_base (8)..(8): 2'-O-methyladenosine
  modified_base (9)..(9): 2'-fluorouracil
  modified_base (10)..(10): cm
  modified_base (11)..(11): 2'-fluorouracil
  modified_base (12)..(12): 2'-fluoroguanine
  modified_base (13)..(13): gm
  modified_base (14)..(14): 2'-fluorouracil
  modified_base (15)..(15): cm
  modified_base (16)..(16): 2'-fluoroadenine
  modified_base (17)..(17): 2'-O-methyladenosine
  modified_base (18)..(18): 2'-fluoroadenine
  modified_base (19)..(19): gm
  modified_base (20)..(20): 2'-fluorocytosine
  modified_base (21)..(21): 2'-O-methyladenosine
cuaagagaucuggucaaagca

SEQ ID NO: 1955 - RNA, 21 nt, Artificial Sequence
  siRNA sense strand against APCS
  modified_base (1)..(1): 2'-fluorocytosine
  modified_base (2)..(2): um
  modified_base (3)..(3): 2'-fluoroguanine
  modified_base (4)..(4): gm
  modified_base (5)..(5): 2'-fluorouracil
  modified_base (6)..(6): cm
  modified_base (7)..(7): 2'-fluoroadenine
  modified_base (8)..(8): 2'-O-methyladenosine
  modified_base (9)..(9): 2'-fluoroadenine
  modified_base (10)..(10): gm
  modified_base (11)..(11): 2'-fluorocytosine
  modified_base (12)..(12): 2'-fluoroadenine
  modified_base (13)..(13): 2'-O-methyladenosine
  modified_base (14)..(14): 2'-fluorocytosine
  modified_base (15)..(15): um
  modified_base (16)..(16): 2'-fluoroguanine
  modified_base (17)..(17): gm
  modified_base (18)..(18): 2'-fluoroadenine
  modified_base (19)..(19): um
  modified_base (20)..(20): 2'-fluoroadenine
  modified_base (21)..(21): cm
cuggucaaagcaacuggauac

SEQ ID NO: 1956 - RNA, 21 nt, Artificial Sequence
  siRNA sense strand against APCS
  modified_base (1)..(1): 2'-fluoroadenine
  modified_base (2)..(2): 2'-O-methyladenosine
  modified_base (3)..(3): 2'-fluoroguanine
  modified_base (4)..(4): cm
  modified_base (5)..(5): 2'-fluoroadenine
  modified_base (6)..(6): 2'-O-methyladenosine
  modified_base (7)..(7): 2'-fluorocytosine
  modified_base (8)..(8): um
  modified_base (9)..(9): 2'-fluoroguanine
  modified_base (10)..(10): gm
  modified_base (11)..(11): 2'-fluoroadenine
  modified_base (12)..(12): 2'-fluorouracil
  modified_base (13)..(13): 2'-O-methyladenosine
  modified_base (14)..(14): 2'-fluorocytosine
  modified_base (15)..(15): um
  modified_base (16)..(16): 2'-fluoroadenine
  modified_base (17)..(17): gm
  modified_base (18)..(18): 2'-fluoroadenine
  modified_base (19)..(19): um
  modified_base (20)..(20): 2'-fluorocytosine
  modified_base (21)..(21): um
aagcaacuggauacuagaucu

SEQ ID NO: 1957 - RNA, 21 nt, Artificial Sequence
  siRNA sense strand against APCS
  modified_base (1)..(1): 2'-fluoroadenine
  modified_base (2)..(2): gm
  modified_base (3)..(3): 2'-fluorocytosine
  modified_base (4)..(4): 2'-O-methyladenosine
  modified_base (5)..(5): 2'-fluoroadenine
  modified_base (6)..(6): cm
  modified_base (7)..(7): 2'-fluorouracil
  modified_base (8)..(8): gm
  modified_base (9)..(9): 2'-fluoroguanine
  modified_base (10)..(10): 2'-O-methyladenosine
  modified_base (11)..(11): 2'-fluorouracil
  modified_base (12)..(12): 2'-fluoroadenine
  modified_base (13)..(13): cm
  modified_base (14)..(14): 2'-fluorouracil
  modified_base (15)..(15): 2'-O-methyladenosine
  modified_base (16)..(16): 2'-fluoroguanine
  modified_base (17)..(17): 2'-O-methyladenosine
  modified_base (18)..(18): 2'-fluorouracil
  modified_base (19)..(19): cm
  modified_base (20)..(20): 2'-fluorouracil
  modified_base (21)..(21): um
agcaacuggauacuagaucuu

SEQ ID NO: 1958 - RNA, 21 nt, Artificial Sequence
  siRNA sense strand against APCS
  modified_base (1)..(1): 2'-fluoroguanine
  modified_base (2)..(2): cm
  modified_base (3)..(3): 2'-fluoroadenine
  modified_base (4)..(4): 2'-O-methyladenosine
  modified_base (5)..(5): 2'-fluorocytosine
  modified_base (6)..(6): um
  modified_base (7)..(7): 2'-fluoroguanine
  modified_base (8)..(8): gm
  modified_base (9)..(9): 2'-fluoroadenine
  modified_base (10)..(10): um
  modified_base (11)..(11): 2'-fluoroadenine
  modified_base (12)..(12): 2'-fluorocytosine
  modified_base (13)..(13): um
  modified_base (14)..(14): 2'-fluoroadenine
  modified_base (15)..(15): gm
  modified_base (16)..(16): 2'-fluoroadenine
  modified_base (17)..(17): um
  modified_base (18)..(18): 2'-fluorocytosine
  modified_base (19)..(19): um
  modified_base (20)..(20): 2'-fluorouracil
  modified_base (21)..(21): 2'-O-methyladenosine
gcaacuggauacuagaucuua

SEQ ID NO: 1959 - RNA, 21 nt, Artificial Sequence
  siRNA sense strand against APCS
  modified_base (1)..(1): 2'-fluoroadenine
  modified_base (2)..(2): um
  modified_base (3)..(3): 2'-fluorocytosine
  modified_base (4)..(4): um
  modified_base (5)..(5): 2'-fluorouracil
  modified_base (6)..(6): 2'-O-methyladenosine
  modified_base (7)..(7): 2'-fluorocytosine
  modified_base (8)..(8): 2'-O-methyladenosine
  modified_base (9)..(9): 2'-fluorouracil
  modified_base (10)..(10): cm
  modified_base (11)..(11): 2'-fluorouracil
  modified_base (12)..(12): 2'-fluoroguanine
  modified_base (13)..(13): cm
  modified_base (14)..(14): 2'-fluoroadenine
  modified_base (15)..(15): gm
  modified_base (16)..(16): 2'-fluorocytosine
  modified_base (17)..(17): um
  modified_base (18)..(18): 2'-fluorocytosine
  modified_base (19)..(19): um
  modified_base (20)..(20): 2'-fluorouracil
  modified_base (21)..(21): um
aucuuacaucugcagcucuuu

SEQ ID NO: 1960 - RNA, 21 nt, Artificial Sequence
  siRNA sense strand against APCS
  modified_base (1)..(1): 2'-fluorouracil
  modified_base (2)..(2): 2'-O-methyladenosine
  modified_base (3)..(3): 2'-fluorocytosine
  modified_base (4)..(4): 2'-O-methyladenosine
  modified_base (5)..(5): 2'-fluorouracil
  modified_base (6)..(6): cm
  modified_base (7)..(7): 2'-fluorouracil
  modified_base (8)..(8): gm
  modified_base (9)..(9): 2'-fluorocytosine
  modified_base (10)..(10): 2'-O-methyladenosine
  modified_base (11)..(11): 2'-fluoroguanine
  modified_base (12)..(12): 2'-fluorocytosine
  modified_base (13)..(13): um
  modified_base (14)..(14): 2'-fluorocytosine
  modified_base (15)..(15): um
  modified_base (16)..(16): 2'-fluorouracil
  modified_base (17)..(17): um
  modified_base (18)..(18): 2'-fluorocytosine
  modified_base (19)..(19): um
  modified_base (20)..(20): 2'-fluorouracil
  modified_base (21)..(21): cm
uacaucugcagcucuuucuuc

SEQ ID NO: 1961 - RNA, 21 nt, Artificial Sequence
  siRNA sense strand against APCS
  modified_base (1)..(1): 2'-fluoroadenine
  modified_base (2)..(2): cm
  modified_base (3)..(3): 2'-fluoroadenine
  modified_base (4)..(4): um
  modified_base (5)..(5): 2'-fluorocytosine
  modified_base (6)..(6): um
  modified_base (7)..(7): 2'-fluoroguanine
  modified_base (8)..(8): cm
  modified_base (9)..(9): 2'-fluoroadenine
  modified_base (10)..(10): gm
  modified_base (11)..(11): 2'-fluorocytosine
  modified_base (12)..(12): 2'-fluorouracil
  modified_base (13)..(13): cm
  modified_base (14)..(14): 2'-fluorouracil
  modified_base (15)..(15): um
  modified_base (16)..(16): 2'-fluorouracil
  modified_base (17)..(17): cm
  modified_base (18)..(18): 2'-fluorouracil
  modified_base (19)..(19): um
  modified_base (20)..(20): 2'-fluorocytosine
  modified_base (21)..(21): um
acaucugcagcucuuucuucu

SEQ ID NO: 1962 - RNA, 21 nt, Artificial Sequence
  siRNA sense strand against APCS
  modified_base (1)..(1): 2'-fluorocytosine
  modified_base (2)..(2): 2'-O-methyladenosine
  modified_base (3)..(3): 2'-fluorouracil
  modified_base (4)..(4): cm
  modified_base (5)..(5): 2'-fluorouracil
  modified_base (6)..(6): gm
  modified_base (7)..(7): 2'-fluorocytosine
  modified_base (8)..(8): 2'-O-methyladenosine
  modified_base (9)..(9): 2'-fluoroguanine
  modified_base (10)..(10): cm
  modified_base (11)..(11): 2'-fluorouracil
  modified_base (12)..(12): 2'-fluorocytosine
  modified_base (13)..(13): um
  modified_base (14)..(14): 2'-fluorouracil
  modified_base (15)..(15): um
  modified_base (16)..(16): 2'-fluorocytosine
  modified_base (17)..(17): um
  modified_base (18)..(18): 2'-fluorouracil
  modified_base (19)..(19): cm
  modified_base (20)..(20): 2'-fluorouracil
  modified_base (21)..(21): um
caucugcagcucuuucuucuu

SEQ ID NO: 1963 - RNA, 21 nt, Artificial Sequence
  siRNA sense strand against APCS
  modified_base (1)..(1): 2'-fluoroadenine
  modified_base (2)..(2): um
  modified_base (3)..(3): 2'-fluorocytosine
  modified_base (4)..(4): um
  modified_base (5)..(5): 2'-fluoroguanine
  modified_base (6)..(6): cm
  modified_base (7)..(7): 2'-fluoroadenine
  modified_base (8)..(8): gm
  modified_base (9)..(9): 2'-fluorocytosine
  modified_base (10)..(10): um
  modified_base (11)..(11): 2'-fluorocytosine
  modified_base (12)..(12): 2'-fluorouracil
  modified_base (13)..(13): um
  modified_base (14)..(14): 2'-fluorouracil
  modified_base (15)..(15): cm
  modified_base (16)..(16): 2'-fluorouracil
  modified_base (17)..(17): um
  modified_base (18)..(18): 2'-fluorocytosine
  modified_base (19)..(19): um
  modified_base (20)..(20): 2'-fluorouracil
  modified_base (21)..(21): um
aucugcagcucuuucuucuuu

SEQ ID NO: 1964 - RNA, 21 nt, Artificial Sequence
  siRNA sense strand against APCS
  modified_base (1)..(1): 2'-fluorouracil
  modified_base (2)..(2): cm
  modified_base (3)..(3): 2'-fluorouracil
  modified_base (4)..(4): gm
  modified_base (5)..(5): 2'-fluorocytosine
  modified_base (6)..(6): 2'-O-methyladenosine
  modified_base (7)..(7): 2'-fluoroguanine
  modified_base (8)..(8): cm
  modified_base (9)..(9): 2'-fluorouracil
  modified_base (10)..(10): cm
  modified_base (11)..(12): 2'-fluorouracil
  modified_base (13)..(13): um
  modified_base (14)..(14): 2'-fluorocytosine
  modified_base (15)..(15): um
  modified_base (16)..(16): 2'-fluorouracil
  modified_base (17)..(17): cm
  modified_base (18)..(18): 2'-fluorouracil
  modified_base (19)..(19): um
  modified_base (20)..(20): 2'-fluorouracil
  modified_base (21)..(21): gm
ucugcagcucuuucuucuuug

SEQ ID NO: 1965 - RNA, 21 nt, Artificial Sequence
  siRNA sense strand against APCS
  modified_base (1)..(1): 2'-fluorocytosine
  modified_base (2)..(2): um
  modified_base (3)..(3): 2'-fluoroguanine
  modified_base (4)..(4): cm
  modified_base (5)..(5): 2'-fluoroadenine
  modified_base (6)..(6): gm
  modified_base (7)..(7): 2'-fluorocytosine
  modified_base (8)..(8): um
  modified_base (9)..(9): 2'-fluorocytosine
  modified_base (10)..(10): um
  modified_base (11)..(12): 2'-fluorouracil
  modified_base (13)..(13): cm
  modified_base (14)..(14): 2'-fluorouracil
  modified_base (15)..(15): um
  modified_base (16)..(16): 2'-fluorocytosine
  modified_base (17)..(17): um
  modified_base (18)..(18): 2'-fluorouracil
  modified_base (19)..(19): um
  modified_base (20)..(20): 2'-fluoroguanine
  modified_base (21)..(21): 2'-O-methyladenosine
cugcagcucuuucuucuuuga

SEQ ID NO: 1966 - RNA, 21 nt, Artificial Sequence
  siRNA sense strand against APCS
  modified_base (1)..(1): 2'-fluorouracil
  modified_base (2)..(2): gm
  modified_base (3)..(3): 2'-fluorocytosine
  modified_base (4)..(4): 2'-O-methyladenosine
  modified_base (5)..(5): 2'-fluoroguanine
  modified_base (6)..(6): cm
  modified_base (7)..(7): 2'-fluorouracil
  modified_base (8)..(8): cm
  modified_base (9)..(9): 2'-fluorouracil
  modified_base (10)..(10): um
  modified_base (11)..(11): 2'-fluorouracil
  modified_base (12)..(12): 2'-fluorocytosine
  modified_base (13)..(13): um
  modified_base (14)..(14): 2'-fluorouracil
  modified_base (15)..(15): cm
  modified_base (16)..(16): 2'-fluorouracil
  modified_base (17)..(17): um
  modified_base (18)..(18): 2'-fluorouracil
  modified_base (19)..(19): gm
  modified_base (20)..(20): 2'-fluoroadenine
  modified_base (21)..(21): 2'-O-methyladenosine
ugcagcucuuucuucuuugaa

SEQ ID NO: 1967 - RNA, 21 nt, Artificial Sequence
  siRNA sense strand against APCS
  modified_base (1)..(1): 2'-fluoroguanine
  modified_base (2)..(2): cm
  modified_base (3)..(3): 2'-fluoroadenine
  modified_base (4)..(4): gm
  modified_base (5)..(5): 2'-fluorocytosine
  modified_base (6)..(6): um
  modified_base (7)..(7): 2'-fluorocytosine
  modified_base (8)..(8): um
  modified_base (9)..(9): 2'-fluorouracil
  modified_base (10)..(10): um
  modified_base (11)..(11): 2'-fluorocytosine
  modified_base (12)..(12): 2'-fluorouracil
  modified_base (13)..(13): um
  modified_base (14)..(14): 2'-fluorocytosine
  modified_base (15)..(15): um
  modified_base (16)..(16): 2'-fluorouracil
  modified_base (17)..(17): um
  modified_base (18)..(18): 2'-fluoroguanine
  modified_base (19)..(19): 2'-O-methyladenosine
  modified_base (20)..(20): 2'-fluoroadenine
  modified_base (21)..(21): um
gcagcucuuucuucuuugaau

SEQ ID NO: 1968 - RNA, 21 nt, Artificial Sequence
  siRNA sense strand against APCS
  modified_base (1)..(1): 2'-fluorocytosine
  modified_base (2)..(2): 2'-O-methyladenosine
  modified_base (3)..(3): 2'-fluoroguanine
  modified_base (4)..(4): cm
  modified_base (5)..(5): 2'-fluorouracil
  modified_base (6)..(6): cm
  modified_base (7)..(7): 2'-fluorouracil
  modified_base (8)..(8): um
  modified_base (9)..(9): 2'-fluorouracil
  modified_base (10)..(10): cm
  modified_base (11)..(12): 2'-fluorouracil
  modified_base (13)..(13): cm
  modified_base (14)..(14): 2'-fluorouracil
  modified_base (15)..(15): um
  modified_base (16)..(16): 2'-fluorouracil
  modified_base (17)..(17): gm
  modified_base (18)..(18): 2'-fluoroadenine
  modified_base (19)..(19): 2'-O-methyladenosine
  modified_base (20)..(20): 2'-fluorouracil
  modified_base (21)..(21): um
cagcucuuucuucuuugaauu

SEQ ID NO: 1969 - RNA, 21 nt, Artificial Sequence
  siRNA sense strand against APCS
  modified_base (1)..(1): 2'-fluorouracil
  modified_base (2)..(2): um
  modified_base (3)..(3): 2'-fluoroguanine
  modified_base (4)..(4): 2'-O-methyladenosine
  modified_base (5)..(5): 2'-fluoroadenine
  modified_base (6)..(6): um
  modified_base (7)..(7): 2'-fluorouracil
  modified_base (8)..(8): um
  modified_base (9)..(9): 2'-fluorocytosine
  modified_base (10)..(10): cm
  modified_base (11)..(11): 2'-fluorouracil
  modified_base (12)..(12): 2'-fluoroadenine
  modified_base (13)..(13): um
  modified_base (14)..(14): 2'-fluorocytosine
  modified_base (15)..(15): um
  modified_base (16)..(16): 2'-fluoroguanine
  modified_base (17)..(17): um
  modified_base (18)..(18): 2'-fluoroadenine
  modified_base (19)..(19): um
  modified_base (20)..(20): 2'-fluoroguanine
  modified_base (21)..(21): um
uugaauuuccuaucuguaugu

SEQ ID NO: 1970 - RNA, 21 nt, Artificial Sequence
  siRNA sense strand against APCS
  modified_base (1)..(1): 2'-fluorouracil
  modified_base (2)..(2): cm
  modified_base (3)..(3): 2'-fluorocytosine
  modified_base (4)..(4): um
  modified_base (5)..(5): 2'-fluoroadenine
  modified_base (6)..(6): um
  modified_base (7)..(7): 2'-fluorocytosine
  modified_base (8)..(8): um
  modified_base (9)..(9): 2'-fluoroguanine
  modified_base (10)..(10): um
  modified_base (11)..(11): 2'-fluoroadenine
  modified_base (12)..(12): 2'-fluorouracil
  modified_base (13)..(13): gm
  modified_base (14)..(14): 2'-fluorouracil
  modified_base (15)..(15): cm
  modified_base (16)..(16): 2'-fluorouracil
  modified_base (17)..(17): gm
  modified_base (18)..(18): 2'-fluorocytosine
  modified_base (19)..(19): cm
  modified_base (20)..(20): 2'-fluorouracil
  modified_base (21)..(21): 2'-O-methyladenosine
uccuaucuguaugucugccua

SEQ ID NO: 1971 - RNA, 21 nt, Artificial Sequence
  siRNA sense strand against APCS
  modified_base (1)..(1): 2'-fluoroadenine
  modified_base (2)..(2): um
  modified_base (3)..(3): 2'-fluorocytosine
  modified_base (4)..(4): um
  modified_base (5)..(5): 2'-fluoroguanine
  modified_base (6)..(6): um
  modified_base (7)..(7): 2'-fluoroadenine
  modified_base (8)..(8): um
  modified_base (9)..(9): 2'-fluoroguanine
  modified_base (10)..(10): um
  modified_base (11)..(11): 2'-fluorocytosine
  modified_base (12)..(12): 2'-fluorouracil
  modified_base (13)..(13): gm
  modified_base (14)..(14): 2'-fluorocytosine
  modified_base (15)..(15): cm
  modified_base (16)..(16): 2'-fluorouracil
  modified_base (17)..(17): 2'-O-methyladenosine
  modified_base (18)..(18): 2'-fluoroadenine
  modified_base (19)..(19): um
  modified_base (20)..(20): 2'-fluorouracil
  modified_base (21)..(21): 2'-O-methyladenosine
aucuguaugucugccuaauua

SEQ ID NO: 1972 - RNA, 21 nt, Artificial Sequence
  siRNA sense strand against APCS
  modified_base (1)..(1): 2'-fluorouracil
  modified_base (2)..(2): cm
  modified_base (3)..(3): 2'-fluorouracil
  modified_base (4)..(4): gm
  modified_base (5)..(5): 2'-fluorouracil
  modified_base (6)..(6): 2'-O-methyladenosine
  modified_base (7)..(7): 2'-fluorouracil
  modified_base (8)..(8): gm
  modified_base (9)..(9): 2'-fluorouracil
  modified_base (10)..(10): cm
  modified_base (11)..(11): 2'-fluorouracil
  modified_base (12)..(12): 2'-fluoroguanine
  modified_base (13)..(13): cm
  modified_base (14)..(14): 2'-fluorocytosine
  modified_base (15)..(15): um
  modified_base (16)..(16): 2'-fluoroadenine
  modified_base (17)..(17): 2'-O-methyladenosine
  modified_base (18)..(18): 2'-fluorouracil
  modified_base (19)..(19): um
  modified_base (20)..(20): 2'-fluoroadenine
  modified_base (21)..(21): 2'-O-methyladenosine
ucuguaugucugccuaauuaa

SEQ ID NO: 1973 - RNA, 21 nt, Artificial Sequence
  siRNA sense strand against APCS
  modified_base (1)..(1): 2'-fluorocytosine
  modified_base (2)..(2): um
  modified_base (3)..(3): 2'-fluoroguanine
  modified_base (4)..(4): um
  modified_base (5)..(5): 2'-fluoroadenine
  modified_base (6)..(6): um
  modified_base (7)..(7): 2'-fluoroguanine
  modified_base (8)..(8): um
  modified_base (9)..(9): 2'-fluorocytosine
  modified_base (10)..(10): um
  modified_base (11)..(11): 2'-fluoroguanine
  modified_base (12)..(12): 2'-fluorocytosine
  modified_base (13)..(13): cm
  modified_base (14)..(14): 2'-fluorouracil
  modified_base (15)..(15): 2'-O-methyladenosine
  modified_base (16)..(16): 2'-fluoroadenine
  modified_base (17)..(17): um
  modified_base (18)..(18): 2'-fluorouracil
  modified_base (19)..(19): 2'-O-methyladenosine
  modified_base (20)..(20): 2'-fluoroadenine
  modified_base (21)..(21): 2'-O-methyladenosine
cuguaugucugccuaauuaaa

SEQ ID NO: 1974 - RNA, 21 nt, Artificial Sequence
  siRNA sense strand against APCS
  modified_base (1)..(1): 2'-fluoroguanine
  modified_base (2)..(2): um
  modified_base (3)..(3): 2'-fluorocytosine
  modified_base (4)..(4): um
  modified_base (5)..(5): 2'-fluoroguanine
  modified_base (6)..(6): cm
  modified_base (7)..(7): 2'-fluorocytosine
  modified_base (8)..(8): um
  modified_base (9)..(9): 2'-fluoroadenine
  modified_base (10)..(10): 2'-O-methyladenosine
  modified_base (11)..(12): 2'-fluorouracil
  modified_base (13)..(13): 2'-O-methyladenosine
  modified_base (14)..(14): 2'-fluoroadenine
  modified_base (15)..(15): 2'-O-methyladenosine
  modified_base (16)..(16): 2'-fluoroadenine
  modified_base (17)..(17): 2'-O-methyladenosine
  modified_base (18)..(18): 2'-fluoroadenine
  modified_base (19)..(19): 2'-O-methyladenosine
  modified_base (20)..(20): 2'-fluorouracil
  modified_base (21)..(21): 2'-O-methyladenosine
gucugccuaauuaaaaaaaua

SEQ ID NO: 1975 - RNA, 23 nt, Artificial Sequence
  siRNA antisense strand against APCS
  modified_base (1)..(1): 2'-fluorouracil
  modified_base (2)..(2): 2'-O-methyladenosine
  modified_base (3)..(3): 2'-fluoroguanine
  modified_base (4)..(4): gm
  modified_base (5)..(5): 2'-fluorocytosine
  modified_base (6)..(6): um
  modified_base (7)..(7): 2'-fluorocytosine
  modified_base (8)..(8): gm
  modified_base (9)..(9): 2'-fluoroadenine
  modified_base (10)..(11): 2'-O-methyladenosine
  modified_base (12)..(12): 2'-fluoroadenine
  modified_base (13)..(13): cm
  modified_base (14)..(14): 2'-fluoroadenine
  modified_base (15)..(15): cm
  modified_base (16)..(16): 2'-fluoroadenine
  modified_base (17)..(17): 2'-O-methyladenosine
  modified_base (18)..(18): 2'-fluoroguanine
  modified_base (19)..(19): gm
  modified_base (20)..(20): 2'-fluorouracil
  modified_base (21)..(21): 2'-O-methyladenosine
  modified_base (22)..(22): 2'-fluoroadenine
  modified_base (23)..(23): 2'-O-methyladenosine
uaggcucgaaaacacaagguaaa

SEQ ID NO: 1976 - RNA, 23 nt, Artificial Sequence
  siRNA antisense strand against APCS
  modified_base (1)..(1): 2'-fluorouracil
  modified_base (2)..(2): 2'-O-methyladenosine
  modified_base (3)..(3): 2'-fluoroguanine
  modified_base (4)..(4): gm
  modified_base (5)..(5): 2'-fluoroadenine
  modified_base (6)..(6): gm
  modified_base (7)..(7): 2'-fluoroadenine
  modified_base (8)..(8): 2'-O-methyladenosine
  modified_base (9)..(9): 2'-fluoroguanine
  modified_base (10)..(10): 2'-O-methyladenosine
  modified_base (11)..(11): gm
  modified_base (12)..(12): 2'-fluoroguanine
  modified_base (13)..(13): cm
  modified_base (14)..(14): 2'-fluorouracil
  modified_base (15)..(15): gm
  modified_base (16)..(16): 2'-fluorouracil
  modified_base (17)..(17): 2'-O-methyladenosine
  modified_base (18)..(18): 2'-fluoroguanine
  modified_base (19)..(19): gm
  modified_base (20)..(20): 2'-fluorocytosine
  modified_base (21)..(21): 2'-O-methyladenosine
  modified_base (22)..(22): 2'-fluorocytosine
  modified_base (23)..(23): gm
uaggagaagaggcuguaggcacg

SEQ ID NO: 1977 - RNA, 23 nt, Artificial Sequence
  siRNA antisense strand against APCS
  modified_base (1)..(1): 2'-fluorouracil
  modified_base (2)..(2): 2'-O-methyladenosine
  modified_base (3)..(3): 2'-fluorouracil
  modified_base (4)..(4): um
  modified_base (5)..(5): 2'-fluoroguanine
  modified_base (6)..(6): um
  modified_base (7)..(7): 2'-fluoroadenine
  modified_base (8)..(8): gm
  modified_base (9)..(9): 2'-fluoroguanine
  modified_base (10)..(10): 2'-O-methyladenosine
  modified_base (11)..(11): gm
  modified_base (12)..(12): 2'-fluoroadenine
  modified_base (13)..(13): 2'-O-methyladenosine
  modified_base (14)..(14): 2'-fluoroguanine
  modified_base (15)..(15): 2'-O-methyladenosine
  modified_base (16)..(16): 2'-fluoroguanine
  modified_base (17)..(17): gm
  modified_base (18)..(18): 2'-fluorocytosine
  modified_base (19)..(19): um
  modified_base (20)..(20): 2'-fluoroguanine
  modified_base (21)..(21): um
  modified_base (22)..(22): 2'-fluoroadenine
  modified_base (23)..(23): gm
uauuguaggagaagaggcuguag

SEQ ID NO: 1978 - RNA, 23 nt, Artificial Sequence
  siRNA antisense strand against APCS
  modified_base (1)..(1): 2'-fluorouracil
  modified_base (2)..(2): cm
  modified_base (3)..(3): 2'-fluoroadenine
  modified_base (4)..(4): gm
  modified_base (5)..(5): 2'-fluorocytosine
  modified_base (6)..(6): 2'-O-methyladenosine
  modified_base (7)..(7): 2'-fluoroadenine
  modified_base (8)..(8): um
  modified_base (9)..(9): 2'-fluoroadenine
  modified_base (10)..(11): cm
  modified_base (12)..(12): 2'-fluorouracil
  modified_base (13)..(13): gm
  modified_base (14)..(14): 2'-fluoroadenine
  modified_base (15)..(15): um
  modified_base (16)..(16): 2'-fluoroguanine
  modified_base (17)..(17): 2'-O-methyladenosine
  modified_base (18)..(18): 2'-fluoroguanine
  modified_base (19)..(19): gm
  modified_base (20)..(20): 2'-fluoroadenine
  modified_base (21)..(21): cm
  modified_base (22)..(22): 2'-fluorouracil
  modified_base (23)..(23): cm
ucagcaauaccugaugaggacuc

SEQ ID NO: 1979 - RNA, 23 nt, Artificial Sequence
  siRNA antisense strand against APCS
  modified_base (1)..(1): 2'-fluorouracil
  modified_base (2)..(2): cm
  modified_base (3)..(3): 2'-fluorocytosine
  modified_base (4)..(4): cm
  modified_base (5)..(5): 2'-fluoroadenine
  modified_base (6)..(6): cm
  modified_base (7)..(7): 2'-fluoroadenine
  modified_base (8)..(8): 2'-O-methyladenosine
  modified_base (9)..(9): 2'-fluoroadenine
  modified_base (10)..(11): gm
  modified_base (12)..(12): 2'-fluoroadenine
  modified_base (13)..(13): cm
  modified_base (14)..(14): 2'-fluorouracil
  modified_base (15)..(15): gm
  modified_base (16)..(16): 2'-fluoroguanine
  modified_base (17)..(17): cm
  modified_base (18)..(18): 2'-fluorouracil
  modified_base (19)..(19): cm
  modified_base (20)..(20): 2'-fluorocytosine
  modified_base (21)..(21): um
  modified_base (22)..(22): 2'-fluoroadenine
  modified_base (23)..(23): um
ucccacaaaggacuggcuccuau

SEQ ID NO: 1980 - RNA, 23 nt, Artificial Sequence
  siRNA antisense strand against APCS
  modified_base (1)..(1): 2'-fluorouracil
  modified_base (2)..(2): cm
  modified_base (3)..(3): 2'-fluorouracil
  modified_base (4)..(4): cm
  modified_base (5)..(5): 2'-fluorocytosine
  modified_base (6)..(6): cm
  modified_base (7)..(7): 2'-fluoroadenine
  modified_base (8)..(8): cm
  modified_base (9)..(9): 2'-fluoroadenine
  modified_base (10)..(11): 2'-O-methyladenosine
  modified_base (12)..(12): 2'-fluoroguanine
  modified_base (13)..(13): gm
  modified_base (14)..(14): 2'-fluoroadenine
  modified_base (15)..(15): cm
  modified_base (16)..(16): 2'-fluorouracil
  modified_base (17)..(17): gm
  modified_base (18)..(18): 2'-fluoroguanine
  modified_base (19)..(19): cm
  modified_base (20)..(20): 2'-fluorouracil
  modified_base (21)..(21): cm
  modified_base (22)..(22): 2'-fluorocytosine
  modified_base (23)..(23): um
ucucccacaaaggacuggcuccu

SEQ ID NO: 1981 - RNA, 23 nt, Artificial Sequence
  siRNA antisense strand against APCS
  modified_base (1)..(1): 2'-fluoroadenine
  modified_base (2)..(2): um
  modified_base (3)..(3): 2'-fluorocytosine
  modified_base (4)..(4): um
  modified_base (5)..(5): 2'-fluorocytosine
  modified_base (6)..(6): um
  modified_base (7)..(7): 2'-fluorocytosine
  modified_base (8)..(8): cm
  modified_base (9)..(9): 2'-fluorocytosine
  modified_base (10)..(10): 2'-O-methyladenosine
  modified_base (11)..(11): cm
  modified_base (12)..(12): 2'-fluoroadenine
  modified_base (13)..(13): 2'-O-methyladenosine
  modified_base (14)..(14): 2'-fluoroadenine
  modified_base (15)..(15): gm
  modified_base (16)..(16): 2'-fluoroguanine
  modified_base (17)..(17): 2'-O-methyladenosine
  modified_base (18)..(18): 2'-fluorocytosine
  modified_base (19)..(19): um
  modified_base (20)..(20): 2'-fluoroguanine
  modified_base (21)..(21): gm
  modified_base (22)..(22): 2'-fluorocytosine
  modified_base (23)..(23): um
aucucucccacaaaggacuggcu

SEQ ID NO: 1982 - RNA, 23 nt, Artificial Sequence
  siRNA antisense strand against APCS
  modified_base (1)..(1): 2'-fluoroadenine
  modified_base (2)..(2): 2'-O-methyladenosine
  modified_base (3)..(3): 2'-fluorouracil
  modified_base (4)..(4): cm
  modified_base (5)..(5): 2'-fluorouracil
  modified_base (6)..(6): cm
  modified_base (7)..(7): 2'-fluorouracil
  modified_base (8)..(8): cm
  modified_base (9)..(9): 2'-fluorocytosine
  modified_base (10)..(10): cm
  modified_base (11)..(11): 2'-O-methyladenosine
  modified_base (12)..(12): 2'-fluorocytosine
  modified_base (13)..(13): 2'-O-methyladenosine
  modified_base (14)..(14): 2'-fluoroadenine
  modified_base (15)..(15): 2'-O-methyladenosine
  modified_base (16)..(16): 2'-fluoroguanine
  modified_base (17)..(17): gm
  modified_base (18)..(18): 2'-fluoroadenine
  modified_base (19)..(19): cm
  modified_base (20)..(20): 2'-fluorouracil
  modified_base (21)..(21): gm
  modified_base (22)..(22): 2'-fluoroguanine
  modified_base (23)..(23): cm
aaucucucccacaaaggacuggc

SEQ ID NO: 1983 - RNA, 23 nt, Artificial Sequence
  siRNA antisense strand against APCS
  modified_base (1)..(1): 2'-fluoroadenine
  modified_base (2)..(2): cm
  modified_base (3)..(3): 2'-fluoroadenine
  modified_base (4)..(4): 2'-O-methyladenosine
  modified_base (5)..(5): 2'-fluoroadenine
  modified_base (6)..(6): um
  modified_base (7)..(7): 2'-fluorocytosine
  modified_base (8)..(8): cm
  modified_base (9)..(9): 2'-fluorocytosine
  modified_base (10)..(10): cm
  modified_base (11)..(11): 2'-O-methyladenosine
  modified_base (12)..(12): 2'-fluoroadenine
  modified_base (13)..(13): um
  modified_base (14)..(14): 2'-fluorocytosine
  modified_base (15)..(15): um
  modified_base (16)..(16): 2'-fluorocytosine
  modified_base (17)..(17): um
  modified_base (18)..(18): 2'-fluorocytosine
  modified_base (19)..(19): cm
  modified_base (20)..(20): 2'-fluorocytosine
  modified_base (21)..(21): 2'-O-methyladenosine
  modified_base (22)..(22): 2'-fluorocytosine
  modified_base (23)..(23): 2'-O-methyladenosine
acaaauccccaaucucucccaca

SEQ ID NO: 1984 - RNA, 23 nt, Artificial Sequence
  siRNA antisense strand against APCS
  modified_base (1)..(1): 2'-fluorouracil
  modified_base (2)..(2): 2'-O-methyladenosine
  modified_base (3)..(3): 2'-fluorocytosine
  modified_base (4)..(4): 2'-O-methyladenosine
  modified_base (5)..(5): 2'-fluoroadenine
  modified_base (6)..(6): 2'-O-methyladenosine
  modified_base (7)..(7): 2'-fluorouracil
  modified_base (8)..(8): cm
  modified_base (9)..(9): 2'-fluorocytosine
  modified_base (10)..(11): cm
  modified_base (12)..(12): 2'-fluoroadenine
  modified_base (13)..(13): 2'-O-methyladenosine
  modified_base (14)..(14): 2'-fluorouracil
  modified_base (15)..(15): cm
  modified_base (16)..(16): 2'-fluorouracil
  modified_base (17)..(17): cm
  modified_base (18)..(18): 2'-fluorouracil
  modified_base (19)..(19): cm
  modified_base (20)..(20): 2'-fluorocytosine
  modified_base (21)..(21): cm
  modified_base (22)..(22): 2'-fluoroadenine
  modified_base (23)..(23): cm
uacaaauccccaaucucucccac

SEQ ID NO: 1985 - RNA, 23 nt, Artificial Sequence
  siRNA antisense strand against APCS
  modified_base (1)..(1): 2'-fluorouracil
  modified_base (2)..(2): gm
  modified_base (3)..(3): 2'-fluorouracil
  modified_base (4)..(4): 2'-O-methyladenosine
  modified_base (5)..(5): 2'-fluorocytosine
  modified_base (6)..(6): 2'-O-methyladenosine
  modified_base (7)..(7): 2'-fluoroadenine
  modified_base (8)..(8): 2'-O-methyladenosine
  modified_base (9)..(9): 2'-fluorouracil
  modified_base (10)..(11): cm
  modified_base (12)..(12): 2'-fluorocytosine
  modified_base (13)..(13): cm
  modified_base (14)..(14): 2'-fluoroadenine
  modified_base (15)..(15): 2'-O-methyladenosine
  modified_base (16)..(16): 2'-fluorouracil
  modified_base (17)..(17): cm
  modified_base (18)..(18): 2'-fluorouracil
  modified_base (19)..(19): cm
  modified_base (20)..(20): 2'-fluorouracil
  modified_base (21)..(21): cm
  modified_base (22)..(22): 2'-fluorocytosine
  modified_base (23)..(23): cm
uguacaaauccccaaucucuccc

SEQ ID NO: 1986 - RNA, 23 nt, Artificial Sequence
  siRNA antisense strand against APCS
  modified_base (1)..(1): 2'-fluorouracil
  modified_base (2)..(2): 2'-O-methyladenosine
  modified_base (3)..(3): 2'-fluorocytosine
  modified_base (4)..(4): cm
  modified_base (5)..(5): 2'-fluorocytosine
  modified_base (6)..(6): um
  modified_base (7)..(7): 2'-fluoroguanine
  modified_base (8)..(8): 2'-O-methyladenosine
  modified_base (9)..(9): 2'-fluorouracil
  modified_base (10)..(10): 2'-O-methyladenosine
  modified_base (11)..(11): gm
  modified_base (12)..(12): 2'-fluoroguanine
  modified_base (13)..(13): cm
  modified_base (14)..(14): 2'-fluoroadenine
  modified_base (15)..(15): gm
  modified_base (16)..(16): 2'-fluoroadenine
  modified_base (17)..(17): cm
  modified_base (18)..(18): 2'-fluoroadenine
  modified_base (19)..(19): gm
  modified_base (20)..(20): 2'-fluoroguanine
  modified_base (21)..(21): 2'-O-methyladenosine
  modified_base (22)..(22): 2'-fluorouracil
  modified_base (23)..(23): 2'-O-methyladenosine
uacccugauaggcagacaggaua

SEQ ID NO: 1987 - RNA, 23 nt, Artificial Sequence
  siRNA antisense strand against APCS
  modified_base (1)..(1): 2'-fluoroguanine
  modified_base (2)..(2): 2'-O-methyladenosine
  modified_base (3)..(3): 2'-fluorouracil
  modified_base (4)..(4): um
  modified_base (5)..(5): 2'-fluorouracil
  modified_base (6)..(6): cm
  modified_base (7)..(7): 2'-fluoroadenine
  modified_base (8)..(8): um
  modified_base (9)..(9): 2'-fluoroadenine
  modified_base (10)..(10): gm
  modified_base (11)..(11): um
  modified_base (12)..(12): 2'-fluorouracil
  modified_base (13)..(13): cm
  modified_base (14)..(14): 2'-fluoroadenine
  modified_base (15)..(15): gm
  modified_base (16)..(16): 2'-fluoroadenine
  modified_base (17)..(17): gm
  modified_base (18)..(18): 2'-fluorocytosine
  modified_base (19)..(19): cm
  modified_base (20)..(20): 2'-fluorouracil
  modified_base (21)..(21): gm
  modified_base (22)..(22): 2'-fluorocytosine
  modified_base (23)..(23): cm
gauuucauaguucagagccugcc

SEQ ID NO: 1988 - RNA, 23 nt, Artificial Sequence
  siRNA antisense strand against APCS
  modified_base (1)..(1): 2'-fluoroguanine
  modified_base (2)..(2): um
  modified_base (3)..(3): 2'-fluorouracil
  modified_base (4)..(4): um
  modified_base (5)..(5): 2'-fluoroguanine
  modified_base (6)..(6): 2'-O-methyladenosine
  modified_base (7)..(7): 2'-fluorouracil
  modified_base (8)..(8): gm
  modified_base (9)..(9): 2'-fluoroadenine
  modified_base (10)..(10): um
  modified_base (11)..(11): gm
  modified_base (12)..(12): 2'-fluoroadenine
  modified_base (13)..(13): cm
  modified_base (14)..(14): 2'-fluoroadenine
  modified_base (15)..(15): um
  modified_base (16)..(16): 2'-fluoroadenine
  modified_base (17)..(17): um
  modified_base (18)..(18): 2'-fluorocytosine
  modified_base (19)..(19): cm
  modified_base (20)..(20): 2'-fluorouracil
  modified_base (21)..(21): cm
  modified_base (22)..(22): 2'-fluorouracil
  modified_base (23)..(23): gm
guuugaugaugacauauccucug

SEQ ID NO: 1989 - RNA, 23 nt, Artificial Sequence
  siRNA antisense strand against APCS
  modified_base (1)..(1): 2'-fluorouracil
  modified_base (2)..(2): gm
  modified_base (3)..(3): 2'-fluoroadenine
  modified_base (4)..(4): gm
  modified_base (5)..(5): 2'-fluorouracil
  modified_base (6)..(6): cm
  modified_base (7)..(7): 2'-fluoroadenine
  modified_base (8)..(8): 2'-O-methyladenosine
  modified_base (9)..(9): 2'-fluoroguanine
  modified_base (10)..(10): 2'-O-methyladenosine
  modified_base (11)..(11): cm
  modified_base (12)..(12): 2'-fluorocytosine
  modified_base (13)..(13): um
  modified_base (14)..(14): 2'-fluorocytosine
  modified_base (15)..(15): 2'-O-methyladenosine
  modified_base (16)..(16): 2'-fluoroguanine
  modified_base (17)..(17): 2'-O-methyladenosine
  modified_base (18)..(18): 2'-fluorocytosine
  modified_base (19)..(19): cm
  modified_base (20)..(20): 2'-fluorocytosine
  modified_base (21)..(21): 2'-O-methyladenosine
  modified_base (22)..(22): 2'-fluorocytosine
  modified_base (23)..(23): 2'-O-methyladenosine
ugagucaagaccucagacccaca

SEQ ID NO: 1990 - RNA, 23 nt, Artificial Sequence
  siRNA antisense strand against APCS
  modified_base (1)..(1): 2'-fluorouracil
  modified_base (2)..(2): um
  modified_base (3)..(3): 2'-fluorouracil
  modified_base (4)..(4): cm
  modified_base (5)..(5): 2'-fluoroadenine
  modified_base (6)..(6): 2'-O-methyladenosine
  modified_base (7)..(7): 2'-fluoroguanine
  modified_base (8)..(8): um
  modified_base (9)..(9): 2'-fluoroguanine
  modified_base (10)..(10): cm
  modified_base (11)..(11): um
  modified_base (12)..(12): 2'-fluorocytosine
  modified_base (13)..(13): um
  modified_base (14)..(14): 2'-fluorocytosine
  modified_base (15)..(15): gm
  modified_base (16)..(16): 2'-fluorouracil
  modified_base (17)..(17): um
  modified_base (18)..(18): 2'-fluoroguanine
  modified_base (19)..(19): 2'-O-methyladenosine
  modified_base (20)..(20): 2'-fluoroguanine
  modified_base (21)..(21): um
  modified_base (22)..(22): 2'-fluorocytosine
  modified_base (23)..(23): 2'-O-methyladenosine
uuucaagugcucucguugaguca

SEQ ID NO: 1991 - RNA, 23 nt, Artificial Sequence
  siRNA antisense strand against APCS
  modified_base (1)..(1): 2'-fluorouracil
  modified_base (2)..(2): um
  modified_base (3)..(3): 2'-fluorouracil
  modified_base (4)..(4): um
  modified_base (5)..(5): 2'-fluorocytosine
  modified_base (6)..(6): 2'-O-methyladenosine
  modified_base (7)..(7): 2'-fluoroadenine
  modified_base (8)..(8): gm
  modified_base (9)..(9): 2'-fluorouracil
  modified_base (10)..(10): gm
  modified_base (11)..(11): cm
  modified_base (12)..(12): 2'-fluorouracil
  modified_base (13)..(13): cm
  modified_base (14)..(14): 2'-fluorouracil
  modified_base (15)..(15): cm
  modified_base (16)..(16): 2'-fluoroguanine
  modified_base (17)..(17): um
  modified_base (18)..(18): 2'-fluorouracil
  modified_base (19)..(19): gm
  modified_base (20)..(20): 2'-fluoroadenine
  modified_base (21)..(21): gm
  modified_base (22)..(22): 2'-fluorouracil
  modified_base (23)..(23): cm
uuuucaagugcucucguugaguc

SEQ ID NO: 1992 - RNA, 23 nt, Artificial Sequence
  siRNA antisense strand against APCS
  modified_base (1)..(1): 2'-fluoroadenine
  modified_base (2)..(2): um
  modified_base (3)..(3): 2'-fluorouracil
  modified_base (4)..(4): um
  modified_base (5)..(5): 2'-fluorouracil
  modified_base (6)..(6): cm
  modified_base (7)..(7): 2'-fluoroadenine
  modified_base (8)..(8): 2'-O-methyladenosine
  modified_base (9)..(9): 2'-fluoroguanine
  modified_base (10)..(10): um
  modified_base (11)..(11): gm
  modified_base (12)..(12): 2'-fluorocytosine
  modified_base (13)..(13): um
  modified_base (14)..(14): 2'-fluorocytosine
  modified_base (15)..(15): um
  modified_base (16)..(16): 2'-fluorocytosine
  modified_base (17)..(17): gm
  modified_base (18)..(18): 2'-fluorouracil
  modified_base (19)..(19): um
  modified_base (20)..(20): 2'-fluoroguanine
  modified_base (21)..(21): 2'-O-methyladenosine
  modified_base (22)..(22): 2'-fluoroguanine
  modified_base (23)..(23): um
auuuucaagugcucucguugagu

SEQ ID NO: 1993 - RNA, 23 nt, Artificial Sequence
  siRNA antisense strand against APCS
  modified_base (1)..(1): 2'-fluorouracil
  modified_base (2)..(2): cm
  modified_base (3)..(3): 2'-fluoroadenine
  modified_base (4)..(4): um
  modified_base (5)..(5): 2'-fluorouracil
  modified_base (6)..(6): um
  modified_base (7)..(7): 2'-fluorouracil
  modified_base (8)..(8): cm
  modified_base (9)..(9): 2'-fluoroadenine
  modified_base (10)..(10): 2'-O-methyladenosine
  modified_base (11)..(11): gm
  modified_base (12)..(12): 2'-fluorouracil
  modified_base (13)..(13): gm
  modified_base (14)..(14): 2'-fluorocytosine
  modified_base (15)..(15): um
  modified_base (16)..(16): 2'-fluorocytosine
  modified_base (17)..(17): um
  modified_base (18)..(18): 2'-fluorocytosine
  modified_base (19)..(19): gm
  modified_base (20)..(20): 2'-fluorouracil
  modified_base (21)..(21): um
  modified_base (22)..(22): 2'-fluoroguanine
  modified_base (23)..(23): 2'-O-methyladenosine
ucauuuucaagugcucucguuga

SEQ ID NO: 1994 - RNA, 23 nt, Artificial Sequence
  siRNA antisense strand against APCS
  modified_base (1)..(1): 2'-fluorouracil
  modified_base (2)..(2): um
  modified_base (3)..(3): 2'-fluorocytosine
  modified_base (4)..(4): 2'-O-methyladenosine
  modified_base (5)..(5): 2'-fluorouracil
  modified_base (6)..(6): um
  modified_base (7)..(7): 2'-fluorouracil
  modified_base (8)..(8): um
  modified_base (9)..(9): 2'-fluorocytosine
  modified_base (10)..(11): 2'-O-methyladenosine
  modified_base (12)..(12): 2'-fluoroguanine
  modified_base (13)..(13): um
  modified_base (14)..(14): 2'-fluoroguanine
  modified_base (15)..(15): cm
  modified_base (16)..(16): 2'-fluorouracil
  modified_base (17)..(17): cm
  modified_base (18)..(18): 2'-fluorouracil
  modified_base (19)..(19): cm
  modified_base (20)..(20): 2'-fluoroguanine
  modified_base (21)..(21): um
  modified_base (22)..(22): 2'-fluorouracil
  modified_base (23)..(23): gm
uucauuuucaagugcucucguug

SEQ ID NO: 1995 - RNA, 23 nt, Artificial Sequence
  siRNA antisense strand against APCS
  modified_base (1)..(1): 2'-fluorouracil
  modified_base (2)..(2): um
  modified_base (3)..(3): 2'-fluorouracil
  modified_base (4)..(4): cm
  modified_base (5)..(5): 2'-fluoroadenine
  modified_base (6)..(6): um
  modified_base (7)..(7): 2'-fluorouracil
  modified_base (8)..(8): um
  modified_base (9)..(9): 2'-fluorouracil
  modified_base (10)..(10): cm
  modified_base (11)..(11): 2'-O-methyladenosine
  modified_base (12)..(12): 2'-fluoroadenine
  modified_base (13)..(13): gm
  modified_base (14)..(14): 2'-fluorouracil
  modified_base (15)..(15): gm
  modified_base (16)..(16): 2'-fluorocytosine
  modified_base (17)..(17): um
  modified_base (18)..(18): 2'-fluorocytosine
  modified_base (19)..(19): um
  modified_base (20)..(20): 2'-fluorocytosine
  modified_base (21)..(21): gm
  modified_base (22)..(22): 2'-fluorouracil
  modified_base (23)..(23): um
uuucauuuucaagugcucucguu

SEQ ID NO: 1996 - RNA, 23 nt, Artificial Sequence
  siRNA antisense strand against APCS
  modified_base (1)..(1): 2'-fluoroadenine
  modified_base (2)..(2): um
  modified_base (3)..(3): 2'-fluorouracil
  modified_base (4)..(4): um
  modified_base (5)..(5): 2'-fluorocytosine
  modified_base (6)..(6): 2'-O-methyladenosine
  modified_base (7)..(7): 2'-fluorouracil
  modified_base (8)..(8): um
  modified_base (9)..(9): 2'-fluorouracil
  modified_base (10)..(10): um
  modified_base (11)..(11): cm
  modified_base (12)..(12): 2'-fluoroadenine
  modified_base (13)..(13): 2'-O-methyladenosine
  modified_base (14)..(14): 2'-fluoroguanine
  modified_base (15)..(15): um
  modified_base (16)..(16): 2'-fluoroguanine
  modified_base (17)..(17): cm
  modified_base (18)..(18): 2'-fluorouracil
  modified_base (19)..(19): cm
  modified_base (20)..(20): 2'-fluorouracil
  modified_base (21)..(21): cm
  modified_base (22)..(22): 2'-fluoroguanine
  modified_base (23)..(23): um
auuucauuuucaagugcucucgu

SEQ ID NO: 1997 - RNA, 23 nt, Artificial Sequence
  siRNA antisense strand against APCS
  modified_base (1)..(1): 2'-fluorocytosine
  modified_base (2)..(2): 2'-O-methyladenosine
  modified_base (3)..(3): 2'-fluorouracil
  modified_base (4)..(4): um
  modified_base (5)..(5): 2'-fluorouracil
  modified_base (6)..(6): cm
  modified_base (7)..(7): 2'-fluoroadenine
  modified_base (8)..(8): um
  modified_base (9)..(9): 2'-fluorouracil
  modified_base (10)..(11): um
  modified_base (12)..(12): 2'-fluorocytosine
  modified_base (13)..(13): 2'-O-methyladenosine
  modified_base (14)..(14): 2'-fluoroadenine
  modified_base (15)..(15): gm
  modified_base (16)..(16): 2'-fluorouracil
  modified_base (17)..(17): gm
  modified_base (18)..(18): 2'-fluorocytosine
  modified_base (19)..(19): um
  modified_base (20)..(20): 2'-fluorocytosine
  modified_base (21)..(21): um
  modified_base (22)..(22): 2'-fluorocytosine
  modified_base (23)..(23): gm
cauuucauuuucaagugcucucg

SEQ ID NO: 1998 - RNA, 23 nt, Artificial Sequence
  siRNA antisense strand against APCS
  modified_base (1)..(1): 2'-fluorouracil
  modified_base (2)..(2): gm
  modified_base (3)..(3): 2'-fluorocytosine
  modified_base (4)..(4): um
  modified_base (5)..(5): 2'-fluorouracil
  modified_base (6)..(6): um
  modified_base (7)..(7): 2'-fluoroguanine
  modified_base (8)..(8): 2'-O-methyladenosine
  modified_base (9)..(9): 2'-fluorocytosine
  modified_base (10)..(10): cm
  modified_base (11)..(11): 2'-O-methyladenosine
  modified_base (12)..(12): 2'-fluoroguanine
  modified_base (13)..(13): 2'-O-methyladenosine
  modified_base (14)..(14): 2'-fluorouracil
  modified_base (15)..(15): cm
  modified_base (16)..(16): 2'-fluorouracil
  modified_base (17)..(17): cm
  modified_base (18)..(18): 2'-fluorouracil
  modified_base (19)..(19): um
  modified_base (20)..(20): 2'-fluoroadenine
  modified_base (21)..(21): gm
  modified_base (22)..(22): 2'-fluoroadenine
  modified_base (23)..(23): cm
ugcuuugaccagaucucuuagac

SEQ ID NO: 1999 - RNA, 23 nt, Artificial Sequence
  siRNA antisense strand against APCS
  modified_base (1)..(1): 2'-fluoroguanine
  modified_base (2)..(2): um
  modified_base (3)..(3): 2'-fluoroadenine
  modified_base (4)..(4): um
  modified_base (5)..(5): 2'-fluorocytosine
  modified_base (6)..(6): cm
  modified_base (7)..(7): 2'-fluoroadenine
  modified_base (8)..(8): gm
  modified_base (9)..(9): 2'-fluorouracil
  modified_base (10)..(10): um
  modified_base (11)..(11): gm
  modified_base (12)..(12): 2'-fluorocytosine
  modified_base (13)..(13): um
  modified_base (14)..(14): 2'-fluorouracil
  modified_base (15)..(15): um
  modified_base (16)..(16): 2'-fluoroguanine
  modified_base (17)..(17): 2'-O-methyladenosine
  modified_base (18)..(18): 2'-fluorocytosine
  modified_base (19)..(19): cm
  modified_base (20)..(20): 2'-fluoroadenine
  modified_base (21)..(21): gm
  modified_base (22)..(22): 2'-fluoroadenine
  modified_base (23)..(23): um
guauccaguugcuuugaccagau

SEQ ID NO: 2000 - RNA, 23 nt, Artificial Sequence
  siRNA antisense strand against APCS
  modified_base (1)..(1): 2'-fluoroadenine
  modified_base (2)..(2): gm
  modified_base (3)..(3): 2'-fluoroadenine
  modified_base (4)..(4): um
  modified_base (5)..(5): 2'-fluorocytosine
  modified_base (6)..(6): um
  modified_base (7)..(7): 2'-fluoroadenine
  modified_base (8)..(8): gm
  modified_base (9)..(9): 2'-fluorouracil
  modified_base (10)..(10): 2'-O-methyladenosine
  modified_base (11)..(11): um
  modified_base (12)..(12): 2'-fluorocytosine
  modified_base (13)..(13): cm
  modified_base (14)..(14): 2'-fluoroadenine
  modified_base (15)..(15): gm
  modified_base (16)..(16): 2'-fluorouracil
  modified_base (17)..(17): um
  modified_base (18)..(18): 2'-fluoroguanine
  modified_base (19)..(19): cm
  modified_base (20)..(20): 2'-fluorouracil
  modified_base (21)..(21): um
  modified_base (22)..(22): 2'-fluorouracil
  modified_base (23)..(23): gm
agaucuaguauccaguugcuuug

SEQ ID NO: 2001 - RNA, 23 nt, Artificial Sequence
  siRNA antisense strand against APCS
  modified_base (1)..(1): 2'-fluoroadenine
  modified_base (2)..(2): 2'-O-methyladenosine
  modified_base (3)..(3): 2'-fluoroguanine
  modified_base (4)..(4): 2'-O-methyladenosine
  modified_base (5)..(5): 2'-fluorouracil
  modified_base (6)..(6): cm
  modified_base (7)..(7): 2'-fluorouracil
  modified_base (8)..(8): 2'-O-methyladenosine
  modified_base (9)..(9): 2'-fluoroguanine
  modified_base (10)..(10): um
  modified_base (11)..(11): 2'-O-methyladenosine
  modified_base (12)..(12): 2'-fluorouracil
  modified_base (13)..(13): cm
  modified_base (14)..(14): 2'-fluorocytosine
  modified_base (15)..(15): 2'-O-methyladenosine
  modified_base (16)..(16): 2'-fluoroguanine
  modified_base (17)..(17): um
  modified_base (18)..(18): 2'-fluorouracil
  modified_base (19)..(19): gm
  modified_base (20)..(20): 2'-fluorocytosine
  modified_base (21)..(21): um
  modified_base (22)..(22): 2'-fluorouracil
  modified_base (23)..(23): um
aagaucuaguauccaguugcuuu

SEQ ID NO: 2002 - RNA, 23 nt, Artificial Sequence
  siRNA antisense strand against APCS
  modified_base (1)..(1): 2'-fluorouracil
  modified_base (2)..(2): 2'-O-methyladenosine
  modified_base (3)..(3): 2'-fluoroadenine
  modified_base (4)..(4): gm
  modified_base (5)..(5): 2'-fluoroadenine
  modified_base (6)..(6): um
  modified_base (7)..(7): 2'-fluorocytosine
  modified_base (8)..(8): um
  modified_base (9)..(9): 2'-fluoroadenine
  modified_base (10)..(10): gm
  modified_base (11)..(11): um
  modified_base (12)..(12): 2'-fluoroadenine
  modified_base (13)..(13): um
  modified_base (14)..(14): 2'-fluorocytosine
  modified_base (15)..(15): cm
  modified_base (16)..(16): 2'-fluoroadenine
  modified_base (17)..(17): gm
  modified_base (18)..(18): 2'-fluorouracil
  modified_base (19)..(19): um
  modified_base (20)..(20): 2'-fluoroguanine
  modified_base (21)..(21): cm
  modified_base (22)..(22): 2'-fluorouracil
  modified_base (23)..(23): um
uaagaucuaguauccaguugcuu

SEQ ID NO: 2003 - RNA, 23 nt, Artificial Sequence
  siRNA antisense strand against APCS
  modified_base (1)..(1): 2'-fluoroadenine
  modified_base (2)..(2): 2'-O-methyladenosine
  modified_base (3)..(3): 2'-fluoroadenine
  modified_base (4)..(4): gm
  modified_base (5)..(5): 2'-fluoroadenine
  modified_base (6)..(6): gm
  modified_base (7)..(7): 2'-fluorocytosine
  modified_base (8)..(8): um
  modified_base (9)..(9): 2'-fluoroguanine
  modified_base (10)..(10): cm
  modified_base (11)..(11): 2'-O-methyladenosine
  modified_base (12)..(12): 2'-fluoroguanine
  modified_base (13)..(13): 2'-O-methyladenosine
  modified_base (14)..(14): 2'-fluorouracil
  modified_base (15)..(15): gm
  modified_base (16)..(16): 2'-fluorouracil
  modified_base (17)..(17): 2'-O-methyladenosine
  modified_base (18)..(18): 2'-fluoroadenine
  modified_base (19)..(19): gm
  modified_base (20)..(20): 2'-fluoroadenine
  modified_base (21)..(21): um
  modified_base (22)..(22): 2'-fluorocytosine
  modified_base (23)..(23): um
aaagagcugcagauguaagaucu

SEQ ID NO: 2004 - RNA, 23 nt, Artificial Sequence
  siRNA antisense strand against APCS
  modified_base (1)..(1): 2'-fluoroguanine
  modified_base (2)..(2): 2'-O-methyladenosine
  modified_base (3)..(3): 2'-fluoroadenine
  modified_base (4)..(4): gm
  modified_base (5)..(5): 2'-fluoroadenine
  modified_base (6)..(6): 2'-O-methyladenosine
  modified_base (7)..(7): 2'-fluoroadenine
  modified_base (8)..(8): gm
  modified_base (9)..(9): 2'-fluoroadenine
  modified_base (10)..(10): gm
  modified_base (11)..(11): cm
  modified_base (12)..(12): 2'-fluorouracil
  modified_base (13)..(13): gm
  modified_base (14)..(14): 2'-fluorocytosine
  modified_base (15)..(15): 2'-O-methyladenosine
  modified_base (16)..(16): 2'-fluoroguanine
  modified_base (17)..(17): 2'-O-methyladenosine
  modified_base (18)..(18): 2'-fluorouracil
  modified_base (19)..(19): gm
  modified_base (20)..(20): 2'-fluorouracil
  modified_base (21)..(21): 2'-O-methyladenosine
  modified_base (22)..(22): 2'-fluoroadenine
  modified_base (23)..(23): gm
gaagaaagagcugcagauguaag

SEQ ID NO: 2005 - RNA, 23 nt, Artificial Sequence
  siRNA antisense strand against APCS
  modified_base (1)..(1): 2'-fluoroadenine
  modified_base (2)..(2): gm
  modified_base (3)..(3): 2'-fluoroadenine
  modified_base (4)..(4): 2'-O-methyladenosine
  modified_base (5)..(5): 2'-fluoroguanine
  modified_base (6)..(6): 2'-O-methyladenosine
  modified_base (7)..(7): 2'-fluoroadenine
  modified_base (8)..(8): 2'-O-methyladenosine
  modified_base (9)..(9): 2'-fluoroguanine
  modified_base (10)..(10): 2'-O-methyladenosine
  modified_base (11)..(11): gm
  modified_base (12)..(12): 2'-fluorocytosine
  modified_base (13)..(13): um
  modified_base (14)..(14): 2'-fluoroguanine
  modified_base (15)..(15): cm
  modified_base (16)..(16): 2'-fluoroadenine
  modified_base (17)..(17): gm
  modified_base (18)..(18): 2'-fluoroadenine
  modified_base (19)..(19): um
  modified_base (20)..(20): 2'-fluoroguanine
  modified_base (21)..(21): um
  modified_base (22)..(22): 2'-fluoroadenine
  modified_base (23)..(23): 2'-O-methyladenosine
agaagaaagagcugcagauguaa

SEQ ID NO: 2006 - RNA, 23 nt, Artificial Sequence
  siRNA antisense strand against APCS
  modified_base (1)..(1): 2'-fluoroadenine
  modified_base (2)..(2): 2'-O-methyladenosine
  modified_base (3)..(3): 2'-fluoroguanine
  modified_base (4)..(4): 2'-O-methyladenosine
  modified_base (5)..(5): 2'-fluoroadenine
  modified_base (6)..(6): gm
  modified_base (7)..(7): 2'-fluoroadenine
  modified_base (8)..(8): 2'-O-methyladenosine
  modified_base (9)..(9): 2'-fluoroadenine
  modified_base (10)..(10): gm
  modified_base (11)..(11): 2'-O-methyladenosine
  modified_base (12)..(12): 2'-fluoroguanine
  modified_base (13)..(13): cm
  modified_base (14)..(14): 2'-fluorouracil
  modified_base (15)..(15): gm
  modified_base (16)..(16): 2'-fluorocytosine
  modified_base (17)..(17): 2'-O-methyladenosine
  modified_base (18)..(18): 2'-fluoroguanine
  modified_base (19)..(19): 2'-O-methyladenosine
  modified_base (20)..(20): 2'-fluorouracil
  modified_base (21)..(21): gm
  modified_base (22)..(22): 2'-fluorouracil
  modified_base (23)..(23): 2'-O-methyladenosine
aagaagaaagagcugcagaugua

SEQ ID NO: 2007 - RNA, 23 nt, Artificial Sequence
  siRNA antisense strand against APCS
  modified_base (1)..(1): 2'-fluoroadenine
  modified_base (2)..(2): 2'-O-methyladenosine
  modified_base (3)..(3): 2'-fluoroadenine
  modified_base (4)..(4): gm
  modified_base (5)..(5): 2'-fluoroadenine
  modified_base (6)..(6): 2'-O-methyladenosine
  modified_base (7)..(7): 2'-fluoroguanine
  modified_base (8)..(8): 2'-O-methyladenosine
  modified_base (9)..(9): 2'-fluoroadenine
  modified_base (10)..(10): 2'-O-methyladenosine
  modified_base (11)..(11): gm
  modified_base (12)..(12): 2'-fluoroadenine
  modified_base (13)..(13): gm
  modified_base (14)..(14): 2'-fluorocytosine
  modified_base (15)..(15): um
  modified_base (16)..(16): 2'-fluoroguanine
  modified_base (17)..(17): cm
  modified_base (18)..(18): 2'-fluoroadenine
  modified_base (19)..(19): gm
  modified_base (20)..(20): 2'-fluoroadenine
  modified_base (21)..(21): um
  modified_base (22)..(22): 2'-fluoroguanine
  modified_base (23)..(23): um
aaagaagaaagagcugcagaugu

SEQ ID NO: 2008 - RNA, 23 nt, Artificial Sequence
  siRNA antisense strand against APCS
  modified_base (1)..(1): 2'-fluorocytosine
  modified_base (2)..(2): 2'-O-methyladenosine
  modified_base (3)..(3): 2'-fluoroadenine
  modified_base (4)..(4): 2'-O-methyladenosine
  modified_base (5)..(5): 2'-fluoroguanine
  modified_base (6)..(6): 2'-O-methyladenosine
  modified_base (7)..(7): 2'-fluoroadenine
  modified_base (8)..(8): gm
  modified_base (9)..(9): 2'-fluoroadenine
  modified_base (10)..(11): 2'-O-methyladenosine
  modified_base (12)..(12): 2'-fluoroguanine
  modified_base (13)..(13): 2'-O-methyladenosine
  modified_base (14)..(14): 2'-fluoroguanine
  modified_base (15)..(15): cm
  modified_base (16)..(16): 2'-fluorouracil
  modified_base (17)..(17): gm
  modified_base (18)..(18): 2'-fluorocytosine
  modified_base (19)..(19): 2'-O-methyladenosine
  modified_base (20)..(20): 2'-fluoroguanine
  modified_base (21)..(21): 2'-O-methyladenosine
  modified_base (22)..(22): 2'-fluorouracil
  modified_base (23)..(23): gm
caaagaagaaagagcugcagaug

SEQ ID NO: 2009 - RNA, 23 nt, Artificial Sequence
  siRNA antisense strand against APCS
  modified_base (1)..(1): 2'-fluorouracil
  modified_base (2)..(2): cm
  modified_base (3)..(3): 2'-fluoroadenine
  modified_base (4)..(4): 2'-O-methyladenosine
  modified_base (5)..(5): 2'-fluoroadenine
  modified_base (6)..(6): gm
  modified_base (7)..(7): 2'-fluoroadenine
  modified_base (8)..(8): 2'-O-methyladenosine
  modified_base (9)..(9): 2'-fluoroguanine
  modified_base (10)..(11): 2'-O-methyladenosine
  modified_base (12)..(12): 2'-fluoroadenine
  modified_base (13)..(13): gm
  modified_base (14)..(14): 2'-fluoroadenine
  modified_base (15)..(15): gm
  modified_base (16)..(16): 2'-fluorocytosine
  modified_base (17)..(17): um
  modified_base (18)..(18): 2'-fluoroguanine
  modified_base (19)..(19): cm
  modified_base (20)..(20): 2'-fluoroadenine
  modified_base (21)..(21): gm
  modified_base (22)..(22): 2'-fluoroadenine
  modified_base (23)..(23): um
ucaaagaagaaagagcugcagau

SEQ ID NO: 2010 - RNA, 23 nt, Artificial Sequence
  siRNA antisense strand against APCS
  modified_base (1)..(1): 2'-fluorouracil
  modified_base (2)..(2): um
  modified_base (3)..(3): 2'-fluorocytosine
  modified_base (4)..(4): 2'-O-methyladenosine
  modified_base (5)..(5): 2'-fluoroadenine
  modified_base (6)..(6): 2'-O-methyladenosine
  modified_base (7)..(7): 2'-fluoroguanine
  modified_base (8)..(8): 2'-O-methyladenosine
  modified_base (9)..(9): 2'-fluoroadenine
  modified_base (10)..(10): gm
  modified_base (11)..(11): 2'-O-methyladenosine
  modified_base (12)..(12): 2'-fluoroadenine
  modified_base (13)..(13): 2'-O-methyladenosine
  modified_base (14)..(14): 2'-fluoroguanine
  modified_base (15)..(15): 2'-O-methyladenosine
  modified_base (16)..(16): 2'-fluoroguanine
  modified_base (17)..(17): cm
  modified_base (18)..(18): 2'-fluorouracil
  modified_base (19)..(19): gm
  modified_base (20)..(20): 2'-fluorocytosine
  modified_base (21)..(21): 2'-O-methyladenosine
  modified_base (22)..(22): 2'-fluoroguanine
  modified_base (23)..(23): 2'-O-methyladenosine
uucaaagaagaaagagcugcaga

SEQ ID NO: 2011 - RNA, 23 nt, Artificial Sequence
  siRNA antisense strand against APCS
  modified_base (1)..(1): 2'-fluoroadenine
  modified_base (2)..(2): um
  modified_base (3)..(3): 2'-fluorouracil
  modified_base (4)..(4): cm
  modified_base (5)..(5): 2'-fluoroadenine
  modified_base (6)..(6): 2'-O-methyladenosine
  modified_base (7)..(7): 2'-fluoroadenine
  modified_base (8)..(8): gm
  modified_base (9)..(9): 2'-fluoroadenine
  modified_base (10)..(10): 2'-O-methyladenosine
  modified_base (11)..(11): gm
  modified_base (12)..(12): 2'-fluoroadenine
  modified_base (13)..(13): 2'-O-methyladenosine
  modified_base (14)..(14): 2'-fluoroadenine
  modified_base (15)..(15): gm
  modified_base (16)..(16): 2'-fluoroadenine
  modified_base (17)..(17): gm
  modified_base (18)..(18): 2'-fluorocytosine
  modified_base (19)..(19): um
  modified_base (20)..(20): 2'-fluoroguanine
  modified_base (21)..(21): cm
  modified_base (22)..(22): 2'-fluoroadenine
  modified_base (23)..(23): gm
auucaaagaagaaagagcugcag

SEQ ID NO: 2012 - RNA, 23 nt, Artificial Sequence
  siRNA antisense strand against APCS
  modified_base (1)..(1): 2'-fluoroadenine
  modified_base (2)..(2): 2'-O-methyladenosine
  modified_base (3)..(3): 2'-fluorouracil
  modified_base (4)..(4): um
  modified_base (5)..(5): 2'-fluorocytosine
  modified_base (6)..(6): 2'-O-methyladenosine
  modified_base (7)..(7): 2'-fluoroadenine
  modified_base (8)..(8): 2'-O-methyladenosine
  modified_base (9)..(9): 2'-fluoroguanine
  modified_base (10)..(11): 2'-O-methyladenosine
  modified_base (12)..(12): 2'-fluoroguanine
  modified_base (13)..(13): 2'-O-methyladenosine
  modified_base (14)..(14): 2'-fluoroadenine
  modified_base (15)..(15): 2'-O-methyladenosine
  modified_base (16)..(16): 2'-fluoroguanine
  modified_base (17)..(17): 2'-O-methyladenosine
  modified_base (18)..(18): 2'-fluoroguanine
  modified_base (19)..(19): cm
  modified_base (20)..(20): 2'-fluorouracil
  modified_base (21)..(21): gm
  modified_base (22)..(22): 2'-fluorocytosine
  modified_base (23)..(23): 2'-O-methyladenosine
aauucaaagaagaaagagcugca

SEQ ID NO: 2013 - RNA, 23 nt, Artificial Sequence
  siRNA antisense strand against APCS
  modified_base (1)..(1): 2'-fluoroadenine
  modified_base (2)..(2): cm
  modified_base (3)..(3): 2'-fluoroadenine
  modified_base (4)..(4): um
  modified_base (5)..(5): 2'-fluoroadenine
  modified_base (6)..(6): cm
  modified_base (7)..(7): 2'-fluoroadenine
  modified_base (8)..(8): gm
  modified_base (9)..(9): 2'-fluoroadenine
  modified_base (10)..(10): um
  modified_base (11)..(11): 2'-O-methyladenosine
  modified_base (12)..(12): 2'-fluoroguanine
  modified_base (13)..(13): gm
  modified_base (14)..(14): 2'-fluoroadenine
  modified_base (15)..(15): 2'-O-methyladenosine
  modified_base (16)..(16): 2'-fluoroadenine
  modified_base (17)..(17): um
  modified_base (18)..(18): 2'-fluorouracil
  modified_base (19)..(19): cm
  modified_base (20)..(20): 2'-fluoroadenine
  modified_base (21)..(21): 2'-O-methyladenosine
  modified_base (22)..(22): 2'-fluoroadenine
  modified_base (23)..(23): gm
acauacagauaggaaauucaaag

SEQ ID NO: 2014 - RNA, 23 nt, Artificial Sequence
  siRNA antisense strand against APCS
  modified_base (1)..(1): 2'-fluorouracil
  modified_base (2)..(2): 2'-O-methyladenosine
  modified_base (3)..(3): 2'-fluoroguanine
  modified_base (4)..(4): gm
  modified_base (5)..(5): 2'-fluorocytosine
  modified_base (6)..(6): 2'-O-methyladenosine
  modified_base (7)..(7): 2'-fluoroguanine
  modified_base (8)..(8): 2'-O-methyladenosine
  modified_base (9)..(9): 2'-fluorocytosine
  modified_base (10)..(10): 2'-O-methyladenosine
  modified_base (11)..(11): um
  modified_base (12)..(12): 2'-fluoroadenine
  modified_base (13)..(13): cm
  modified_base (14)..(14): 2'-fluoroadenine
  modified_base (15)..(15): gm
  modified_base (16)..(16): 2'-fluoroadenine
  modified_base (17)..(17): um
  modified_base (18)..(18): 2'-fluoroadenine
  modified_base (19)..(19): gm
  modified_base (20)..(20): 2'-fluoroguanine
  modified_base (21)..(21): 2'-O-methyladenosine
  modified_base (22)..(22): 2'-fluoroadenine
  modified_base (23)..(23): 2'-O-methyladenosine
uaggcagacauacagauaggaaa

SEQ ID NO: 2015 - RNA, 23 nt, Artificial Sequence
  siRNA antisense strand against APCS
  modified_base (1)..(1): 2'-fluorouracil
  modified_base (2)..(2): 2'-O-methyladenosine
  modified_base (3)..(3): 2'-fluoroadenine
  modified_base (4)..(4): um
  modified_base (5)..(5): 2'-fluorouracil
  modified_base (6)..(6): 2'-O-methyladenosine
  modified_base (7)..(7): 2'-fluoroguanine
  modified_base (8)..(8): gm
  modified_base (9)..(9): 2'-fluorocytosine
  modified_base (10)..(10): 2'-O-methyladenosine
  modified_base (11)..(11): gm
  modified_base (12)..(12): 2'-fluoroadenine
  modified_base (13)..(13): cm
  modified_base (14)..(14): 2'-fluoroadenine
  modified_base (15)..(15): um
  modified_base (16)..(16): 2'-fluoroadenine
  modified_base (17)..(17): cm
  modified_base (18)..(18): 2'-fluoroadenine
  modified_base (19)..(19): gm
  modified_base (20)..(20): 2'-fluoroadenine
  modified_base (21)..(21): um
  modified_base (22)..(22): 2'-fluoroadenine
  modified_base (23)..(23): gm
uaauuaggcagacauacagauag

SEQ ID NO: 2016 - RNA, 23 nt, Artificial Sequence
  siRNA antisense strand against APCS
  modified_base (1)..(1): 2'-fluorouracil
  modified_base (2)..(2): um
  modified_base (3)..(3): 2'-fluoroadenine
  modified_base (4)..(4): 2'-O-methyladenosine
  modified_base (5)..(5): 2'-fluorouracil
  modified_base (6)..(6): um
  modified_base (7)..(7): 2'-fluoroadenine
  modified_base (8)..(8): gm
  modified_base (9)..(9): 2'-fluoroguanine
  modified_base (10)..(10): cm
  modified_base (11)..(11): 2'-O-methyladenosine
  modified_base (12)..(12): 2'-fluoroguanine
  modified_base (13)..(13): 2'-O-methyladenosine
  modified_base (14)..(14): 2'-fluorocytosine
  modified_base (15)..(15): 2'-O-methyladenosine
  modified_base (16)..(16): 2'-fluorouracil
  modified_base (17)..(17): 2'-O-methyladenosine
  modified_base (18)..(18): 2'-fluorocytosine
  modified_base (19)..(19): 2'-O-methyladenosine
  modified_base (20)..(20): 2'-fluoroguanine
  modified_base (21)..(21): 2'-O-methyladenosine
  modified_base (22)..(22): 2'-fluorouracil
  modified_base (23)..(23): 2'-O-methyladenosine
uuaauuaggcagacauacagaua

SEQ ID NO: 2017 - RNA, 23 nt, Artificial Sequence
  siRNA antisense strand against APCS
  modified_base (1)..(1): 2'-fluorouracil
  modified_base (2)..(2): um
  modified_base (3)..(3): 2'-fluorouracil
  modified_base (4)..(4): 2'-O-methyladenosine
  modified_base (5)..(5): 2'-fluoroadenine
  modified_base (6)..(6): um
  modified_base (7)..(7): 2'-fluorouracil
  modified_base (8)..(8): 2'-O-methyladenosine
  modified_base (9)..(9): 2'-fluoroguanine
  modified_base (10)..(10): gm
  modified_base (11)..(11): cm
  modified_base (12)..(12): 2'-fluoroadenine
  modified_base (13)..(13): gm
  modified_base (14)..(14): 2'-fluoroadenine
  modified_base (15)..(15): cm
  modified_base (16)..(16): 2'-fluoroadenine
  modified_base (17)..(17): um
  modified_base (18)..(18): 2'-fluoroadenine
  modified_base (19)..(19): cm
  modified_base (20)..(20): 2'-fluoroadenine
  modified_base (21)..(21): gm
  modified_base (22)..(22): 2'-fluoroadenine
  modified_base (23)..(23): um
uuuaauuaggcagacauacagau

SEQ ID NO: 2018 - RNA, 23 nt, Artificial Sequence
  siRNA antisense strand against APCS
  modified_base (1)..(1): 2'-fluorouracil
  modified_base (2)..(2): 2'-O-methyladenosine
  modified_base (3)..(3): 2'-fluorouracil
  modified_base (4)..(4): um
  modified_base (5)..(5): 2'-fluorouracil
  modified_base (6)..(6): um
  modified_base (7)..(7): 2'-fluorouracil
  modified_base (8)..(8): um
  modified_base (9)..(9): 2'-fluorouracil
  modified_base (10)..(11): 2'-O-methyladenosine
  modified_base (12)..(12): 2'-fluorouracil
  modified_base (13)..(13): um
  modified_base (14)..(14): 2'-fluoroadenine
  modified_base (15)..(15): gm
  modified_base (16)..(16): 2'-fluoroguanine
  modified_base (17)..(17): cm
  modified_base (18)..(18): 2'-fluoroadenine
  modified_base (19)..(19): gm
  modified_base (20)..(20): 2'-fluoroadenine
  modified_base (21)..(21): cm
  modified_base (22)..(22): 2'-fluoroadenine
  modified_base (23)..(23): um
uauuuuuuuaauuaggcagacau

The invention claimed is:

1. A double-stranded nucleic acid for suppressing expression of an APCS gene, the double-stranded nucleic acid consisting of a sense-strand nucleic acid and an antisense-strand nucleic acid and comprising a double-strand region having at least 11 base pairs, wherein the antisense-strand nucleic acid has a chain length of at least 17 nucleotides and at most 30 nucleotides wherein the antisense strand nucleic acid comprises a base sequence 5'-UU-CAAAGAAGAAAGAGC-3' (residues 1-17 of SEQ ID NO:1249) that is complementary to a target APCS mRNA sequence SEQ ID NO: 1894.

2. The double-stranded nucleic acid according to claim 1, wherein the double-strand region has 11 to 27 base pairs and a nucleotide at position 2 counted from the 5' end of the antisense-strand nucleic acid is complementary to a ribonucleotide at position 2 counted from 3' end of the target APCS mRNA sequence.

3. The double-stranded nucleic acid according to claim 1, wherein a 3' end of the sense-strand nucleic acid and the 5' end of the antisense-strand nucleic acid and/or the 5' end of the sense-strand nucleic acid and the 3' end of the antisense-strand nucleic acid form a blunt end.

4. The double-stranded nucleic acid according to claim 1, wherein the sense-strand nucleic acid consists of 21 nucleotides and the antisense-strand nucleic acid consists of 23 nucleotides.

5. The double-stranded nucleic acid according to claim 4, comprising a double-strand region having 17-21 base pairs, wherein 40 to 65% of the nucleotides in the double-strand region are 2'-O-methyl modified nucleotides.

6. The double-stranded nucleic acid according to claim 1, wherein the antisense-strand nucleic acid comprises the base sequence set forth in any one of SEQ ID NOS: 1249 to 1253.

7. The double-stranded nucleic acid according to claim 1, wherein the sense-strand nucleic acid comprises the base sequence set forth in any one of SEQ ID NOS: 606 to 610.

8. The double-stranded nucleic acid according to claim 1, wherein the sense-strand nucleic acid comprises the base sequence set forth in any one of SEQ ID NOS: 606 to 610, and correspondingly thereto, the antisense-strand nucleic acid comprises the base sequence set forth in any one of SEQ ID NOS: 1249 to 1253.

9. The double-stranded nucleic acid according to claim 1, comprising a ligand.

10. A single stranded nucleic acid consisting of 17 to 30 nucleotides and comprising the base sequence 5'-UU-CAAAGAAGAAAGAGC-3' (residues 1-17 of SEQ ID NO:1249).

11. A pharmaceutical composition comprising the double-stranded nucleic acid according to claim 1.

12. A method for suppressing expression of an APCS gene, comprising a step of administering the double stranded nucleic acid according to claim 1 to a human.

13. The double-stranded nucleic acid according to claim 1, wherein the antisense-strand nucleic acid consists of the base sequence 5'-AAUUCAAAGAAGAAAGAGCUGCA-3' (SEQ ID NO:2012).

14. The double-stranded nucleic acid according to claim 1, wherein the sense-strand nucleic acid consists of the base sequence 5'-CAGCUCUUUCUUCUUUGAAUU-3' (SEQ ID NO:1968), and the antisense-strand nucleic acid consists of the base sequence 5'-AAUU-CAAAGAAGAAAGAGCUGCA-3' (SEQ ID NO:2012).

* * * * *